United States Patent
Brutnell et al.

(10) Patent No.: US 10,407,670 B2
(45) Date of Patent: Sep. 10, 2019

(54) COMPOSITIONS AND METHODS FOR INCREASING PLANT GROWTH AND YIELD USING RICE PROMOTERS

(71) Applicant: Benson Hill Biosystems, Inc., Research Triangle Park, NC (US)

(72) Inventors: Thomas P. Brutnell, St. Louis, MO (US); Douglas W. Bryant, St. Louis, MO (US); Todd Christopher Mockler, St. Louis, MO (US); Lin Wang, Grover, MO (US)

(73) Assignee: BENSON HILL BIOSYSTEMS, INC., Research Triangle Park, NC (US)

( * ) Notice: Subject to any disclaimer, the term of this patent is extended or adjusted under 35 U.S.C. 154(b) by 201 days.

(21) Appl. No.: 15/328,133

(22) PCT Filed: Jul. 23, 2015

(86) PCT No.: PCT/US2015/041757
§ 371 (c)(1),
(2) Date: Jan. 23, 2017

(87) PCT Pub. No.: WO2016/014809
PCT Pub. Date: Jan. 28, 2016

(65) Prior Publication Data
US 2017/0218387 A1  Aug. 3, 2017
US 2018/0030467 A9  Feb. 1, 2018

Related U.S. Application Data

(60) Provisional application No. 62/029,068, filed on Jul. 25, 2014.

(51) Int. Cl.
*C12N 15/82* (2006.01)
*C12N 9/16* (2006.01)
*C07K 14/415* (2006.01)

(52) U.S. Cl.
CPC .............. *C12N 9/16* (2013.01); *C07K 14/415* (2013.01); *C12N 15/8222* (2013.01); *C12N 15/8223* (2013.01); *C12N 15/8243* (2013.01); *C12Y 301/03037* (2013.01)

(58) Field of Classification Search
None
See application file for complete search history.

(56) References Cited

U.S. PATENT DOCUMENTS

| | | |
|---|---|---|
| 7,186,982 B1 | 3/2007 | Kiser |
| 2007/0020621 A1 | 1/2007 | Boukharov et al. |
| 2007/0039076 A1 | 2/2007 | Boukharov et al. |
| 2011/0030089 A1 | 2/2011 | Unkefer et al. |
| 2014/0154806 A1 | 6/2014 | Schneider et al. |

FOREIGN PATENT DOCUMENTS

| | | |
|---|---|---|
| CA | 2 372 123 A1 | 11/2000 |
| EP | 2 599 871 A2 | 6/2013 |
| WO | WO 2016/182847 A1 | 11/2017 |

OTHER PUBLICATIONS

Bakhsh et al 2011 (Arch. Biol. Sci. Belgrade 63:2 p. 299-307).*
Yu et al 2002 (Science 296: p. 79-93).*
Grigston, J., et al., "D-Glucose sensing by a plasma membrane regulator of G signaling protein, AtRGS1," *FEBS Letters*, 2008, vol. 582(25-26),pp. 3577-3584.
"Introduction to the Rice Genome Annotation Project: Release 7 Unified Rice Pseudomolecules," Rice Genome Annotation Project—National Science Foundation, 2013, 1 page.
"Rice Locus Identifier Search: L0C_0s12g19470," Rice Genome Annotation Project—National Science Foundation, 2013, pp. 1-4.
"Rice Locus Identifier Search: L0C_0s07g37250," Rice Genome Annotation Project—National Science Foundation, 2013, pp. 1-3.
Rosenthal, D. et al., "Over-expressing the $C_3$ photosynthesis cycle enzyme Sedoheptulose- 1-7 Bisphosphatase improves photosynthetic carbon gain and yield under fully open air $CO_2$ fumigation (FACE)," *BMC Plant Biology*, 2011, vol. 11(1), pp. 1-12.
Feng, L., et al., "Overexpression of sedoheptulose-1,7-bisphosphatase enhances photosynthesis and growth under salt stress in transgenic rice plants," *Functional Plant Biology*, 2007, vol. 34(9), pp. 822-834.
Lefebvre, S., et al., "Increased Sedoheptulose-1,7Bbisphosphatase Activity in transgenic Tobacco Plants Stimulates Photosynthesis and rowth from an Early Stage in Development," *Plant Physiology*, 2005, vol. 138(1), pp. 451-460.
Miyagawa, Y., et al., "Overexpression of a cyanobacterial fuctose-1,6/sedoheptulose-1,7-bisphosphatase in tobacco enhances photosynthesis an growth," *Nature Biotechnology*, 2001, vol. 19(10), pp. 965-969.
Qiao, X., et al., "Effect of foliar spray of zinc on chloroplast [beta]-carbonic anydrase expression and enzyme activity in rice (*Oryza sativa* L.) leaves," *Acta PhysiolPlant*, vol. 36(2), pp. 263-272, (published online Oct. 22, 2013).

* cited by examiner

Primary Examiner — Matthew R Keogh
(74) Attorney, Agent, or Firm — Womble Bond Dickinson (US) LLP

(57) ABSTRACT

Compositions and methods for improving plant growth are provided herein. Compositions comprise promoter sequences that direct expression of an operably linked nucleotide in a developmentally regulated manner. Polynucleotides, polypeptides, and expression constructs for expressing genes of interest whose expression may improve agronomic properties including but not limited to crop yield, biotic and abiotic stress tolerance, and early vigor, plants comprising the polynucleotides, polypeptides, and expression constructs, and methods of producing transgenic plants are also provided.

19 Claims, No Drawings
Specification includes a Sequence Listing.

COMPOSITIONS AND METHODS FOR INCREASING PLANT GROWTH AND YIELD USING RICE PROMOTERS

CROSS-REFERENCE TO RELATED APPLICATIONS

This application is a national stage filing under 35 U.S.C. 371 of PCT/US2015/041757 filed Jul. 23, 2015, which International Application was published by the International Bureau in English on Jan. 28, 2016, and application claims priority from U.S. Provisional Application No. 62/029,068, filed Jul. 25, 2014, which applications are hereby incorporated in their entirety by reference in this application.

FIELD OF THE INVENTION

The present invention relates to compositions and methods for controlling expression of nucleotides involved in plant growth and development.

BACKGROUND OF THE INVENTION

The ever-increasing world population and the dwindling supply of arable land available for agriculture fuels research towards developing plants with increased biomass and yield. Conventional means for crop and horticultural improvements utilize selective breeding techniques to identify plants having desirable characteristics. However, such selective breeding techniques have several drawbacks, namely that these techniques are typically labor intensive and result in plants that often contain heterogeneous genetic components that may not always result in the desirable trait being passed on from parent plants. Advances in molecular biology provide means to modify the germplasm of plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

Traits of interest include plant biomass and yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigor may also be important factors in determining yield. Optimizing the abovementioned factors may therefore contribute to increasing crop yield.

An increase in seed yield is a particularly important trait since the seeds of many plants are important for human and animal consumption. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves, and stems into the growing seed. The endosperm, in particular, assimilates the metabolic precursors of carbohydrates, oils and proteins and synthesizes them into storage macromolecules to fill out the grain. An increase in plant biomass is important for forage crops like alfalfa, silage corn and hay. Many genes are involved in plant growth and development. Therefore, methods are needed for modulating such genes to increase crop yield.

SUMMARY OF THE INVENTION

Compositions and methods for regulating gene expression in a plant are provided. The methods increase plant growth resulting in higher crop yield. Compositions comprise novel nucleotide sequences for developmentally-regulated promoters, DNA constructs comprising the promoters operably linked to coding and nucleotide sequences of interest, and transformed plants, seeds, plant parts, and plant cells having stably incorporated into their genomes a construct comprising a promoter sequence of the invention. The promoters can be used to alter plant growth by modulating the expression level and/or expression pattern of one or more nucleotide and/or coding sequences of interest, particularly photosynthetically-related genes. The expression of genes that encode proteins involved in plant photosynthesis can be modulated to increase plant growth, plant mass, and plant yield. Methods to use these promoters to modulate the expression level and/or developmental expression profiles of genes encoding photosynthetic proteins are described herein.

Embodiments of the invention include:

1. A method of expressing a gene of interest in a plant comprising transforming a plant cell with a DNA construct comprising a developmentally-regulated promoter having a sequence comprising the sequence set forth in SEQ ID NOs: 3, 4, 5, 15, 17, 19, or 21 operably linked to a coding region for a gene of interest, and regenerating a transformed plant from said plant cell.
2. The method of embodiment 1, wherein said coding region encodes a protein involved in photosynthesis.
3. The method of embodiment 2, wherein said coding region encodes an enzyme having sedoheptulose-1,7-bisphosphatase activity.
4. The method of embodiment 3, wherein said coding region comprises the sequence of SEQ ID NO: 1, or a sequence having at least 80% identity to SEQ ID NO: 1.
5. The method of embodiment 3, wherein said coding region encodes the amino acid sequence of SEQ ID NO: 2, or a sequence having at least 80% identity to SEQ ID NO: 2.
6. The method of embodiment 3, wherein said coding region is selected from the group consisting of SEQ ID Nos: 23, 25, 27, 29, 31, 33, 35, 37, 39, 41, 43, 45, 47, 49, 51, 53, 55, 57, and 59, or a sequence having at least 80% identity to a sequence selected from the group consisting of SEQ ID Nos: 23, 25, 27, 29, 31, 33, 35, 37, 39, 41, 43, 45, 47, 49, 51, 53, 55, 57, and 59.
7. The method of embodiment 3, wherein said coding region encodes an amino acid sequence selected from the group consisting of SEQ ID NOs: 24, 26, 28, 30, 32, 34, 36, 38, 40, 42, 44, 46, 48, 50, 52, 54, 56, 58, 60, and 81-268, or a sequence having at least 80% identity to a sequence selected from the group consisting of SEQ ID NOs: 24, 26, 28, 30, 32, 34, 36, 38, 40, 42, 44, 46, 48, 50, 52, 54, 56, 58, 60, and 81-268.
8. The method of embodiment 1 wherein the transformed plant is a monocotyledonous plant.
9. The method of embodiment 1 wherein the transformed plant is a dicotyledonous plant.

10. A DNA construct comprising, in operable linkage,
   a. a promoter sequence that drives expression in a plant cell in a developmentally-regulated manner, wherein said promoter comprises a sequence selected from the DNA sequences set forth in SEQ ID NOs: 3, 4, 5, 15, 17, 19, and 21 and,
   b. a nucleic acid sequence encoding a protein involved in photosynthesis.
11. The nucleic acid sequence of embodiment 10, wherein said nucleic acid sequence encoding a protein involved in photosynthesis comprises the nucleic acid sequence of SEQ ID NO: 1, or a sequence having at least 80% identity to SEQ ID NO: 1.
12. The nucleic acid sequence of embodiment 10, wherein said nucleic acid sequence encoding a protein involved in photosynthesis encodes the amino acid sequence of SEQ ID NO: 2, or a sequence having at least 80% identity to SEQ ID NO: 2.
13. The nucleic acid sequence of embodiment 10, wherein the nucleic acid sequence encoding a protein involved in photosynthesis comprises the nucleic acid sequence of SEQ ID NO: 23, 25, 27, 29, 31, 33, 35, 37, 39, 41, 43, 45, 47, 49, 51, 53, 55, 57, 59, or a nucleic acid sequence having at least 80% identity to SEQ ID NO: 23, 25, 27, 29, 31, 33, 35, 37, 39, 41, 43, 45, 47, 49, 51, 53, 55, 57, or 59.
14. The nucleic acid sequence of embodiment 10, wherein the nucleic acid sequence encoding a protein involved in photosynthesis encodes the amino acid sequence of SEQ ID NO: 24, 26, 28, 30, 32, 34, 36, 38, 40, 42, 44, 46, 48, 50, 52, 54, 56, 58, 60, 81-267 or 268, or a sequence having at least 80% identity to SEQ ID NO: 24, 26, 28, 30, 32, 34, 36, 38, 40, 42, 44, 46, 48, 50, 52, 54, 56, 58, 60, 81-267 or 268.
15. The nucleic acid sequence of embodiment 10, wherein said promoter comprises the sequence of SEQ ID NO: 3, SEQ ID NO: 4, SEQ ID NO: 5, SEQ ID NO: 13, SEQ ID NO: 15, SEQ ID NO: 17, SEQ ID NO: 19, or SEQ ID NO: 21, or a sequence having at least 80% identity to SEQ ID NO: 3, SEQ ID NO: 4, SEQ ID NO: 5, SEQ ID NO: 13, SEQ ID NO: 15, SEQ ID NO: 17, SEQ ID NO: 19, or SEQ ID NO: 21.
16. A transformed plant having stably incorporated into its genome, a DNA construct comprising a promoter that drives expression in a plant in a developmentally-regulated manner, operably lined to a nucleic acid sequence encoding a protein involved in photosynthesis, wherein said promoter comprises a sequence selected from the sequences set forth in SEQ ID NOs: 3, 4, 5, 15, 17, 19, and 21.
17. The transformed plant of embodiment 16 wherein said promoter comprises the sequence of SEQ ID NO: 3, SEQ ID NO: 4, SEQ ID NO: 5, SEQ ID NO: 13, SEQ ID NO: 15, SEQ ID NO: 17, SEQ ID NO: 19, or SEQ ID NO: 21, or a sequence having at least 80% identity to SEQ ID NO: 3, SEQ ID NO: 4, SEQ ID NO: 5, SEQ ID NO: 13, SEQ ID NO: 15, SEQ ID NO: 17, SEQ ID NO: 19, or SEQ ID NO: 21.
18. The transformed plant of embodiment 16 wherein said protein involved in photosynthesis is encoded by the sequence of SEQ ID NO: 1, or a sequence having at least 80% identity to SEQ ID NO: 1.
19. The transformed plant of embodiment 16 wherein the protein involved in photosynthesis comprises the sequence of SEQ ID NO: 2, or a sequence having at least 80% identity to SEQ ID NO: 2.
20. The transformed plant of embodiment 16 wherein the protein involved in photosynthesis is encoded by the sequence of SEQ ID NO: 23, 25, 27, 29, 31, 33, 35, 37, 39, 41, 43, 45, 47, 49, 51, 53, 55, 57, or 59, or a sequence having at least 80% identity to a sequence set forth in SEQ ID NO: 23, 25, 27, 29, 31, 33, 35, 37, 39, 41, 43, 45, 47, 49, 51, 53, 55, 57, or 59.
21. The transformed plant of embodiment 16 wherein the protein involved in photosynthesis comprises the sequence of SEQ ID NO: 24, 26, 28, 30, 32, 34, 36, 38, 40, 42, 44, 46, 48, 50, 52, 54, 56, 58, 60, 81-267, or 268, or a sequence having at least 80% identity to a sequence set forth in SEQ ID NO: 24, 26, 28, 30, 32, 34, 36, 38, 40, 42, 44, 46, 48, 50, 52, 54, 56, 58, 60, 81-267 or 268.
22. A method of modulating the growth of a plant comprising inserting into the nuclear genome of a plant cell a promoter sequence upstream of a photosynthetic gene of interest to alter the expression of a said photosynthetic gene, wherein said promoter sequence drives expression in a plant in a developmentally-regulated manner, wherein said promoter sequence is selected from the group consisting of SEQ ID NO: 3, SEQ ID NO: 4, SEQ ID NO: 5, SEQ ID NO: 13, SEQ ID NO: 15, SEQ ID NO: 17, SEQ ID NO: 19, and SEQ ID NO: 21.
23. The method of embodiment 23 wherein said photosynthetic gene encodes a protein having sedoheptulose-1,7-bisphosphatase activity.
24. The method of embodiment 23, wherein said promoter sequence is selected from the group consisting of SEQ ID NO: 3, SEQ ID NO: 4, SEQ ID NO: 5, SEQ ID NO: 13, SEQ ID NO: 15, SEQ ID NO: 17, SEQ ID NO: 19, and SEQ ID NO: 21, or a sequence having at least 80% identity to SEQ ID NO: 3, SEQ ID NO: 4, SEQ ID NO: 5, SEQ ID NO: 13, SEQ ID NO: 15, SEQ ID NO: 17, SEQ ID NO: 19, and SEQ ID NO: 21.
25. The method of embodiment 24 wherein said sedoheptulose-1,7-bisphosphatase protein has at least 80% identity to SEQ ID NO: 2.
26. A method of modulating the growth of a plant comprising inserting into the nuclear genome of a plant cell a transcriptional enhancer sequence to alter the expression of a plant gene encoding a sedoheptulose 1,7-bisphosphatase polypeptide.
27. A method of modulating the growth of a plant comprising modulating the expression of a plant gene encoding sedoheptulose 1,7-bisphosphatase by modulating the expression of a transcription factor or transcription factors known to interact with said gene encoding a sedoheptulose 1,7-bisphosphatase polypeptide.
28. A method of modulating the growth of a plant comprising modulating the expression of a plant gene encoding sedoheptulose 1,7-bisphosphatase wherein said expression is modulated by inserting a transposable element DNA sequence at a location in the plant genomic DNA within 2 kb of said gene encoding a sedoheptulose 1,7-bisphosphatase polypeptide.
29. A method of modulating the growth of a plant comprising modulating the chromatin content or structure of a particular region of a plant's genome within 2 kb of a plant gene encoding a sedoheptulose 1,7-bisphosphatase polypeptide.
30. A method of modulating the growth of a plant comprising altering the DNA methylation status within 2 kb of a particular region of a plant's genome such that the expression of a plant gene encoding a sedoheptulose 1,7-bisphosphatase polypeptide is altered.
31. The method of embodiment 3, wherein said coding region encodes an amino acid sequence selected from the group of SEQ ID NOs: 81-103, or a sequence having at least 80% identity to a sequence selected from the group of SEQ ID NOs: 81-103.
32. The nucleic acid sequence of embodiment 10, wherein said nucleic acid sequence encoding a protein involved in photosynthesis encodes an amino acid sequence selected from the group of SEQ ID NOs: 81-103, or a sequence having at least 80% identity to a sequence selected from the group of SEQ ID NOs: 81-103.
33. The transformed plant of embodiment 16 wherein the protein involved in photosynthesis comprises a sequence selected from the group of SEQ ID NOs: 81-103, or a sequence having at least 80% identity to a sequence selected from the group of SEQ ID NOs: 81-103.
34. The method of embodiment 24 wherein said sedoheptulose-1,7-bisphosphatase protein has at least 80% identity to a sequence selected from the group of SEQ ID NOs: 81-103.
35. The method of embodiment 2 wherein said coding region encodes a polypeptide that acts in the Calvin-Benson cycle.
36. The nucleic acid sequence of embodiment 10 wherein said nucleic acid sequence encoding a protein involved in photosynthesis encodes a protein that acts in the Calvin-Benson cycle.
37. The transformed plant of embodiment 16 wherein said protein involved in photosynthesis is a protein that acts in the Calvin-Benson cycle.
38. The method of embodiment 36 wherein said polypeptide that acts in the Calvin-Benson cycle is selected from the group of SEQ ID NOs: 2, 24, 26, or 81-155, or a polypeptide having at least 80% identity to a sequence selected from the group of SEQ ID NOs: 2, 24, 26, or 81-155.
39. The nucleic acid sequence of embodiment 37 wherein said protein that acts in the Calvin-Benson cycle is selected from the group of SEQ ID NOs: 2, 24, 26, and 81-155, or a polypeptide having at least 80% identity to a sequence selected from the group of SEQ ID NOs: 2, 24, 26, and 81-155.
40. The transformed plant of embodiment 38 wherein said protein that acts in the Calvin-Benson cycle is selected from the group of SEQ ID NOs: 2, 24, 26, and 81-155, or a polypeptide having at least 80% identity to a sequence selected from the group of SEQ ID NOs: 2, 24, 26, and 81-155.
41. Transformed seed of the transformed plant of any one of embodiments 16-21.

DETAILED DESCRIPTION OF THE INVENTION

Compositions and methods for increasing crop biomass and yield are provided. Crop yield is intimately linked with photosynthetic metabolism, as photosynthesis is the route through which carbon dioxide is fixed for plant growth. Methods for improving photosynthetic metabolism have the potential to drive significant improvements in plant growth and crop yield. The compositions of the invention comprise novel nucleotide sequences for plant promoters, particularly developmentally-regulated promoters, more particularly, the promoter sequences set forth in SEQ ID NOs: 3, 4, 5, 15, 17, 19, or 21, and fragments and variants thereof. The promoter sequences of the invention are useful for expressing operably linked nucleotide sequences in a developmentally-regulated manner. They can be used to manipulate photosynthetic metabolism and plant growth by driving expression of genes encoding proteins involved in photosynthesis.

Methods of the invention include the manipulation of photosynthesis through altering the expression of genes encoding proteins involved in photosynthesis. While such genes may be overexpressed using strong constitutive promoters, in many cases it may be beneficial to use non-constitutive promoters to drive such genes. Non-constitutive promoters of particular interest are the promoters of the invention that drive expression in a developmentally-regulated manner. Such developmentally-regulated promoters may be used to preferentially drive expression of at least one nucleotide or gene of interest in particular plant tissues at an age in which a particular benefit may be derived. Genes of interest include photosynthetic genes as many of these genes have a distinct developmental peak in their expression. By using the promoters of the invention to alter the expression level and/or profile of one or more of these photosynthetic genes in a plant of interest, photosynthetic metabolism may be optimized. Such optimization of photosynthetic metabolism provides for increased plant growth and elevated yield in crop plants.

The compositions of the invention include isolated nucleic acid molecules comprising the promoter nucleotide sequences set forth in SEQ ID NOs: 3, 4, 5, 15, 17, 19, and 21, and fragments and variants thereof. By "promoter" is intended to mean a regulatory region of DNA usually comprising a TATA box capable of directing RNA polymerase II to initiate RNA synthesis at the appropriate transcription initiation site for a particular coding sequence. Eukaryotic promoters are complex and are comprised of components that include a TATA box consensus sequence at about 35 base pairs 5' relative to the transcription start site or cap site which is defined as +1. The TATA motif is the site where the TATA-binding-protein (TBP) as part of a complex of several polypeptides (TFIID complex) binds and productively interacts (directly or indirectly) with factors bound to other sequence elements of the promoter. This TFIID complex in turn recruits the RNA polymerase II complex to be positioned for the start of transcription generally 25 to 30 base pairs downstream of the TATA element and promotes elongation thus producing RNA molecules. The sequences around the start of transcription (designated INR) of some poll genes seem to provide an alternate binding site for factors that also recruit members of the TFIID complex and thus "activate" transcription. These INR sequences are particularly relevant in promoters that lack functional TATA elements providing the core promoter binding sites for eventual transcription. It has been proposed that promoters containing both a functional TATA and INR motif are the most efficient in transcriptional activity. (Zenzie-Gregory et al (1992) J. Biol. Chem. 267:2823-2830). See, for example, U.S. Pat. No. 6,072,050, herein incorporated by reference.

As discussed, promoter may additionally comprise other recognition sequences generally positioned upstream or 5' to the TATA box, referred to as upstream promoter elements, which influence the transcription initiation rate. It is recognized that having identified the nucleotide sequences for the promoter regions disclosed herein, it is within the state of the art to isolate and identify further regulatory elements in the 5' untranslated region upstream from the particular promoter regions identified herein. Thus, for example, the promoter regions disclosed herein may further comprise upstream regulatory elements and sequences. Variants of the promoter sequence include those sequences having at least about 90%, about 95%, about 98% sequence identity with SEQ ID NOs: 3, 4, 5, 15, 17, 19, and 21 and comprise a TATA box and necessary upstream promoter elements. By "fragment" is intended a portion of the nucleic acid sequence. "Variants" is intended to mean substantially similar sequences. Fragments and variants of the promoter sequences retain biological activity and hence are capable of driving expression of a gene of interest in a developmentally-regulated manner.

By driving expression in a developmentally-regulated manner is intended that expression is increased or decreased in plant tissues of a different age or stage of development. For example, in leaf samples, increased expression may be observed in older leaf tissue relative to younger leaf tissue. In another example, a distinct expression peak may be observed in mature, but not yet senescent, tissue, with expression decreasing in senescent tissue.

The promoter sequences of the present invention, when assembled within a DNA construct such that the promoter is operably linked to a nucleotide sequence of interest, enable expression of the nucleotide sequence in the cells of a plant stably transformed with this DNA construct. "Operably linked" is intended to mean a functional linkage between two or more elements. For example, an operable linkage between a promoter of the present invention and a heterologous nucleotide of interest is a functional link that allows for expression of the heterologous nucleotide sequence of interest. Operably linked elements may be contiguous or non-contiguous. When used to refer to the joining of two protein coding regions, by operably linked is intended that the coding regions are in the same reading frame. The cassette may additionally contain at least one additional gene to be co-transformed into the plant. Alternatively, the additional gene(s) can be provided on multiple expression cassettes or DNA constructs. Such an expression cassette or construct is provided with a plurality of restriction sites and/or recombination sites for insertion of the heterologous nucleotide sequence of interest to be under the transcriptional regulation of the promoter regions of the invention. The expression cassette may additionally contain selectable marker genes.

In this manner, the nucleotide sequences for the promoters of the invention are provided in expression cassettes along with a nucleotide sequence of interest, typically a heterologous nucleotide sequence, for expression in the plant of interest. By "heterologous nucleotide sequence" is intended to mean a sequence that is not naturally operably linked with the promoter sequence. While this nucleotide sequence is heterologous to the promoter sequence, it may be homologous, or native, or heterologous, or foreign, to the plant host. It is recognized that the promoter may also drive expression of its homologous or native nucleotide sequence. In this case, the transformed plant will have a change in phenotype. Heterologous nucleotide sequences include, but are not limited to, photosynthetic coding sequences, insecticidal coding sequences, herbicide-tolerance coding sequences, coding sequences for secondary metabolites, nutritional quality coding sequences, visible marker coding sequences, and selectable marker coding sequences.

Genes involved in photosynthesis include, but are not limited to, sedoheptulose-1,7-bisphosphatase (SBPase) (SEQ ID NOs: 1-2, 81-103), fructose-1,6-bisphosphatase (FBPase) (SEQ ID NOs: 23-24, 104-125), fructose-1,6-bisphosphate aldolase (FBP aldolase) (SEQ ID NOs: 25-26, 126-155), transketolase (SEQ ID NOs: 27-28), the Rubisco small subunit (SEQ ID NOs: 29-30), the Rubisco large subunit (SEQ ID NOs: 31-32), Rubisco activase (SEQ ID NOs: 33-34), the ADP-glucose pyrophosphorylase (AGPase) large subunit (SEQ ID NOs: 35-36, 156-199), the AGPase small subunit (SEQ ID NOs: 37-38, 200-221), carbonic anhydrase (SEQ ID NOs: 39-40, 222-268), PEP carboxylase (PEPC) (SEQ ID NOs: 41-42), pyruvate phosphate dikinase (PPDK) (SEQ ID NOs: 43-44), malate dehydrogenase (SEQ ID NOs: 45-46), malic enzyme (SEQ ID NOs: 47-48), phosphoglycerate kinase (SEQ ID NOs: 49-50), glyceraldehyde 3-phosphate dehydrogenase (SEQ ID NOs: 51-52), triose phosphate isomerase (SEQ ID NOs: 53-54), ribulose 5-phosphate isomerase (SEQ ID NOs: 55-56), phosphoribulokinase (SEQ ID NOs: 57-58), and ribulose 5-phosphate 3-epimerase (SEQ ID NOs: 59-60). Variants, fragments, and homologs of such sequences may also be used in the practice of the invention. In one embodiment, genes of interest include those genes involved in the Calvin-Benson cycle.

In particular embodiments of the present invention, a promoter is used to drive the expression of a gene encoding a sedoheptulose-1,7-bisphosphatase (SBPase) enzyme. By an SBPase enzyme is meant an enzyme that catalyzes the removal of a phosphate group from sedoheptulose-1,7-bisphosphate to produce sedoheptulose-7-phosphate. Examples of SBPase enzymes include the polypeptides described by SEQ ID NO: 2 and SEQ ID NOs: 81-103.

Fragments and variants of the polynucleotides and amino acid sequences encoded thereby may also be expressed by the promoters of the present invention. By "fragment" is intended a portion of the polynucleotide or a portion of the amino acid sequence. "Variants" is intended to mean substantially similar sequences. For polynucleotides, a variant comprises a polynucleotide having deletions (i.e., truncations) at the 5' and/or 3' end; deletion and/or addition of one or more nucleotides at one or more internal sites in the native polynucleotide; and/or substitution of one or more nucleotides at one or more sites in the native polynucleotide. As used herein, a "native" polynucleotide or polypeptide comprises a naturally occurring nucleotide sequence or amino acid sequence, respectively. Generally, variants of a particular polynucleotide of the invention will have at least about 75%, 80%, 85%, 90%, 91%, 92%, 93%, 94%, 95%, 96%, 97%, 98%, 99% or more sequence identity to that particular polynucleotide as determined by sequence alignment programs and parameters as described elsewhere herein.

"Variant" amino acid or protein is intended to mean an amino acid or protein derived from the native amino acid or protein by deletion (so-called truncation) of one or more amino acids at the N-terminal and/or C-terminal end of the native protein; deletion and/or addition of one or more amino acids at one or more internal sites in the native protein; or substitution of one or more amino acids at one or more sites in the native protein. Variant proteins encompassed by the present invention are biologically active, that is they continue to possess the desired biological activity of the native protein. Biologically active variants of a native polypeptide will have at least about 80%, 85%, 90%, 91%, 92%, 93%, 94%, 95%, 96%, 97%, 98%, 99% or more sequence identity to the amino acid sequence for the native sequence as determined by sequence alignment programs and parameters described herein. A biologically active variant of a protein of the invention may differ from that protein by as few as 1-15 amino acid residues, as few as 1-10, such as 6-10, as few as 5, as few as 4, 3, 2, or even 1 amino acid residue.

Variant sequences may also be identified by analysis of existing databases of sequenced genomes. In this manner, corresponding sequences can be identified and used in the methods of the invention.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) CABIOS 4:11-17; the local alignment algorithm of Smith et al. (1981) Adv. Appl. Math. 2:482; the global alignment algorithm of Needleman and Wunsch (1970) J. Mol. Biol. 48:443-453; the search-for-local alignment method of Pearson and Lipman (1988) Proc. Natl. Acad. Sci. 85:2444-2448; the algorithm of Karlin and Altschul (1990) Proc. Natl. Acad. Sci. USA 872264, modified as in Karlin and Altschul (1993) Proc. Natl. Acad. Sci. USA 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) Gene 73:237-244 (1988); Higgins et al. (1989) CABIOS 5:151-153; Corpet et al. (1988) Nucleic Acids Res. 16:10881-90; Huang et al. (1992) CABIOS 8:155-65; and Pearson et al. (1994) Meth. Mol. Biol. 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et al (1990) J. Mol. Biol. 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. To obtain gapped alignments for comparison purposes, Gapped BLAST (in BLAST 2.0) can be utilized as described in Altschul et al. (1997) Nucleic Acids Res. 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See www.ncbi.nlm.nih.gov. Alignment may also be performed manually by inspection.

Such genes and coding regions to be expressed by a promoter of the invention can be codon optimized for expression in a plant of interest. A "codon-optimized gene" is a gene having its frequency of codon usage designed to mimic the frequency of preferred codon usage of the host cell. Nucleic acid molecules can be codon optimized, either wholly or in part. Because any one amino acid (except for methionine and tryptophan) is encoded by a number of codons, the sequence of the nucleic acid molecule may be changed without changing the encoded amino acid. Codon optimization is when one or more codons are altered at the nucleic acid level such that the amino acids are not changed but expression in a particular host organism is increased. Those having ordinary skill in the art will recognize that codon tables and other references providing preference information for a wide range of organisms are available in the art (see, e.g., Zhang et al. (1991) Gene 105:61-72; Murray et al. (1989) Nucl. Acids Res. 17:477-508). Methodology for optimizing a nucleotide sequence for expression in a plant is provided, for example, in U.S. Pat. No. 6,015,891, and the references cited therein.

The promoters of the invention may be used in recombinant polynucleotides. A "recombinant polynucleotide" comprises a combination of two or more chemically linked nucleic acid segments which are not found directly joined in nature. By "directly joined" is intended the two nucleic acid segments are immediately adjacent and joined to one another by a chemical linkage. In specific embodiments, the recombinant polynucleotide comprises a polynucleotide of interest or active variant or fragment thereof such that an additional chemically linked nucleic acid segment is located either 5', 3' or internal to the polynucleotide of interest. Alternatively, the chemically-linked nucleic acid segment of the recombinant polynucleotide can be formed by deletion of a sequence. The additional chemically linked nucleic acid segment or the sequence deleted to join the linked nucleic acid segments can be of any length, including for example, 1, 2, 3, 4, 5, 6, 7, 8, 9, 10, 15, 20 or greater nucleotides. Various methods for making such recombinant polynucleotides are disclosed herein, including, for example, by chemical synthesis or by the manipulation of isolated segments of polynucleotides by genetic engineering techniques. In specific embodiments, the recombinant polynucleotide can comprise a recombinant DNA sequence or a recombinant RNA sequence. A "fragment of a recombinant polynucleotide" comprises at least one of a combination of two or more chemically linked amino acid segments which are not found directly joined in nature.

By "altering" or "modulating" the expression level of a gene is intended that the expression of the gene is upregulated or downregulated. It is recognized that in some instances, plant growth and yield are increased by increasing the expression levels of one or more genes encoding proteins involved in photosynthesis, i.e. upregulating expression. Likewise, in some instances, plant growth and yield may be increased by decreasing the expression levels of one or more genes encoding proteins involved in photosynthesis, i.e. downregulating expression. Thus, the invention encompasses the upregulation or downregulation of one or more genes encoding proteins involved in photosynthesis. Further, the methods include the upregulation of at least one gene encoding a protein involved in photosynthesis and the downregulation of at least one gene encoding a protein involved in photosynthesis in a plant of interest. By modulating the concentration and/or activity of at least one of the genes encoding a protein involved in photosynthesis in a transgenic plant is intended that the concentration and/or activity is increased or decreased by at least about 1%, about 5%, about 10%, about 20%, about 30%, about 40%, about 50%, about 60%, about 70%, about 80%, or about 90% or greater relative to a native control plant, plant part, or cell which did not have the sequence of the invention introduced.

It is recognized that the expression levels of the genes encoding proteins involved in photosynthesis can be controlled by the use of one or more promoters of the invention. For example, if a 30% increase is desired at a particular developmental stage, a promoter will be selected to provide the appropriate expression level at the appropriate developmental stage. The expression level of the photosynthetic gene of interest may be measured directly, for example, by assaying for the level of the photosynthetic gene transcript or of the encoded protein in the plant. Methods for such assays are well-known in the art. For example, Northern blotting or quantitative reverse transcriptase-PCR (qRT-PCR) may be used to assess transcript levels, while western blotting, ELISA assays, or enzyme assays may be used to assess protein levels.

In order to successfully manipulate the expression level and/or expression profile of candidate genes, genetic tools, including enhancer elements, may be used. The present invention describes a number of novel promoters that were identified through bioinformatic analyses of transcriptomic data. At least one of the promoters may be used to increase the expression of a gene of interest.

The compositions of the invention are used to alter expression of genes of interest in a plant, particularly genes involved in photosynthesis. Therefore, the expression of a gene encoding a protein involved in photosynthesis may be modulated as compared to a control plant. A "subject plant or plant cell" is one in which genetic alteration, such as transformation, has been effected as to a gene of interest, or is a plant or plant cell which is descended from a plant or cell so altered and which comprises the alteration. A "control" or "control plant" or "control plant cell" provides a reference point for measuring changes in phenotype of the subject plant or plant cell. Thus, the expression levels are higher or lower than those in the control plant depending on the methods of the invention.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e. with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

While the invention is described in terms of transformed plants, it is recognized that transformed organisms of the invention also include plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

The invention encompasses isolated or substantially purified polynucleotide or nucleic acid compositions. An "isolated" or "purified" polynucleotide, or biologically active portion thereof, is substantially or essentially free from components that normally accompany or interact with the polynucleotide as found in its naturally occurring environment. Thus, an isolated or purified polynucleotide is substantially free of other cellular material, or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived.

As indicated, the promoter sequences of the invention are useful for regulating gene expression in a developmentally-regulated manner. Using the methods of the invention, genes encoding proteins involved in photosynthesis can be upregulated or downregulated in a plant of interest. It may be desirable to upregulate at least one gene encoding a protein involved in photosynthesis while simultaneously downregulating at least one different gene, including a gene encoding a protein involved in photosynthesis. Methods for increasing the expression or upregulating a gene of interest are known in the art and any can be used in the methods of the invention. In one embodiment, upregulation can be achieved by transforming a plant with an expression cassette comprising a promoter of the invention operably linked to at least one open reading frame encoding a protein of interest.

To downregulate expression, antisense constructions, complementary to at least a portion of the messenger RNA (mRNA) for the sequences of a gene of interest, particularly a photosynthetic gene of interest can be constructed. Antisense nucleotides are designed to hybridize with the corresponding mRNA. Modifications of the antisense sequences may be made as long as the sequences hybridize to and interfere with expression of the corresponding mRNA. In this manner, antisense constructions having 70%, optimally 80%, more optimally 85%, 90%, 95% or greater sequence identity to the corresponding sequences to be silenced may be used. Furthermore, portions of the antisense nucleotides may be used to disrupt the expression of the target gene.

The polynucleotides of the invention can be used to isolate corresponding sequences from other plants. In this manner, methods such as PCR, hybridization, and the like can be used to identify such sequences based on their sequence homology or identity to the sequences set forth herein. Sequences isolated based on their sequence identity to the entire sequences set forth herein or to variants and fragments thereof are encompassed by the present invention. Such sequences include sequences that are orthologs of the disclosed sequences. "Orthologs" is intended to mean genes derived from a common ancestral gene and which are found in different species as a result of speciation. Genes found in different species are considered orthologs when their nucleotide sequences and/or their encoded protein sequences share at least about 75%, about 80%, about 85%, about 90%, about 91%, about 92%, about 93%, about 94%, about 95%, about 96%, about 97%, about 98%, about 99%, or greater sequence identity. Functions of orthologs are often highly conserved among species. Thus, isolated polynucleotides that have transcription activation or enhancer activities and which share at least about 75% or more sequence identity to the sequences disclosed herein, or to variants or fragments thereof, are encompassed by the present invention.

Variant sequences can be isolated by PCR. Methods for designing PCR primers and PCR cloning are generally known in the art and are disclosed in Sambrook et al. (1989) Molecular Cloning: A Laboratory Manual (2d ed., Cold Spring Harbor Laboratory Press, Plainview, N.Y.). See also Innis et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York).

Variant sequences may also be identified by analysis of existing databases of sequenced genomes. In this manner, corresponding promoter sequences or sequences encoding photosynthetic proteins can be identified and used in the methods of the invention. Methods of alignment of sequences for comparison are well known in the art. Thus, the determination of percent sequence identity between any two sequences can be accomplished using mathematical algorithms, such as those algorithms set forth above. Alignment may also be performed manually by inspection.

The promoters of the invention can be provided in DNA constructs or expression cassettes for expression of genes encoding photosynthetic proteins in a plant of interest. The cassette will include a promoter sequence of the invention operably linked to a gene of interest, particularly a photosynthetic gene of interest. The cassette may additionally contain at least one additional gene to be co-transformed into the organism. Alternatively, the additional gene(s) can be provided on multiple expression cassettes. Such an expression cassette is provided with a plurality of restriction sites and/or recombination sites for insertion of the polynucleotide to be under the transcriptional regulation of the promoters of the invention. The expression cassette may additionally contain selectable marker genes.

The expression cassette will include in the 5'-3' direction of transcription, a transcriptional and translational initiation region (i.e., a promoter of the invention), a polynucleotide encoding a photosynthetic protein, and a transcriptional and translational termination region (i.e., termination region) functional in plants.

A number of photosynthetic proteins have been identified and are well-known in the art. The metabolic pathways of photosynthesis are well-studied and include light capture, electron transfer, the Calvin-Benson cycle, starch biosynthesis, and sucrose biosynthesis. Additionally, photosynthetic microorganisms employ a carbon concentrating mechanism (CCM), while many higher plants employ C4 photosynthesis, which includes a C4 carbon shuttle, or CAM photosynthesis, which includes pathways to temporally regulate carbon fixation. The metabolic pathways of photosynthesis have been described, e.g., in Taiz and Zeiger, eds. (2002) Plant Physiology (Sinauer Associates, Sunderland, Mass.). A number of photosynthetic proteins have been annotated, including sedoheptulose-1,7-bisphosphatase (SBPase) (SEQ ID NOs: 1-2, 81-103), fructose-1,6-bisphosphatase (FBPase) (SEQ ID NOs: 23-24, 104-125), fructose-1,6-bisphosphate aldolase (FBP aldolase) (SEQ ID NOs: 25-26, 126-155), transketolase (SEQ ID NOs: 27-28), the Rubisco small subunit (SEQ ID NOs: 29-30), the Rubisco large subunit (SEQ ID NOs: 31-32), Rubisco activase (SEQ ID NOs: 33-34), the ADP-glucose pyrophosphorylase (AGPase) large subunit (SEQ ID NOs: 35-36, 156-199), the AGPase small subunit (SEQ ID NOs: 37-38, 200-221), carbonic anhydrase (SEQ ID NOs: 39-40, 222-268), PEP carboxylase (PEPC) (SEQ ID NOs: 41-42), pyruvate phosphate dikinase (PPDK) (SEQ ID NOs: 43-44), malate dehydrogenase (SEQ ID NOs: 45-46), malic enzyme (SEQ ID NOs: 47-48), phosphoglycerate kinase (SEQ ID NOs: 49-50), glyceraldehyde 3-phosphate dehydrogenase (SEQ ID NOs: 51-52), triose phosphate isomerase (SEQ ID NOs: 53-54), ribulose 5-phosphate isomerase (SEQ ID NOs: 55-56), phosphoribulokinase (SEQ ID NOs: 57-58), and ribulose 5-phosphate 3-epimerase (SEQ ID NOs: 59-60). Additionally, regulators of these and other photosynthetic proteins and of genes encoding these and other photosynthetic proteins may be expressed from the promoters of the present invention. Such regulators may include transcription factors that regulate the expression of genes encoding photosynthetic proteins (see, for example, Dong et al. (2014) Biochem Biophys Res Commun 450:453-458), ubiquitin ligases (see, for example, Li et al. (2013) Plant Biotechnol J 11:432-445), kinases and other proteins that modify photosynthetic proteins post-translationally (see, for example, Tiessen et al. (2003) Plant J 35:490-500 and Bergantino et al. (1995) J Biol Chem 270:8474-8481), proteins such as ferredoxin and thioredoxin that regulate the redox status of photosynthetic proteins (see, for example, Balmer et al. (2003) Proc Natl Acad Sci USA 100:370-375 and Hirasawa et al. (1999) Biochemistry 38:5200-5205), and the like.

Plant terminators are known in the art and include those available from the Ti-plasmid of *A. tumefaciens*, such as the octopine synthase and nopaline synthase termination regions. See also Guerineau et al. (1991) Mol. Gen. Genet. 262:141-144; Proudfoot (1991) Cell 64:671-674; Sanfacon et al. (1991) Genes Dev. 5:141-149; Mogen et al. (1990) Plant Cell 2:1261-1272; Munroe et al. (1990) Gene 91:151-158; Ballas et al. (1989) Nucleic Acids Res. 17:7891-7903; and Joshi et al. (1987) Nucleic Acids Res. 15:9627-9639.

As indicated, the promoters of the present invention can be used in expression cassettes to transform plants of interest. Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) Biotechniques 4:320 334), electroporation (Riggs et al. (1986) Proc. Natl. Acad. Sci. USA 83:5602 5606, *Agrobacterium*-mediated transformation (U.S. Pat. Nos. 5,563,055 and 5,981,840), direct gene transfer (Paszkowski et al. (1984) EMBO J. 3:2717 2722), and ballistic particle acceleration (see, for example, U.S. Pat. Nos. 4,945,050; 5,879,918; 5,886,244; and, 5,932,782; Tomes et al. (1995) in Plant Cell, Tissue, and Organ Culture: Fundamental Methods, ed. Gamborg and Phillips (Springer-Verlag, Berlin); McCabe et al. (1988) Biotechnology 6:923 926); and Lec1 transformation (WO 00/28058). Also see Weissinger et al. (1988) Ann. Rev. Genet. 22:421 477; Sanford et al. (1987) Particulate Science and Technology 5:27 37 (onion); Christou et al. (1988) Plant Physiol. 87:671 674 (soybean); McCabe et al. (1988) Bio/Technology 6:923 926 (soybean); Finer and McMullen (1991) In Vitro Cell Dev. Biol. 27P:175-182 (soybean); Singh et al. (1998) Theor. Appl. Genet. 96:319-324 (soybean); Datta et al. (1990) Biotechnology 8:736 740 (rice); Klein et al. (1988) Proc. Natl. Acad. Sci. USA 85:4305 4309 (maize); Klein et al. (1988) Biotechnology 6:559 563 (maize); U.S. Pat. Nos. 5,240,855; 5,322,783; and, 5,324,646; Klein et al. (1988) Plant Physiol. 91:440 444 (maize); Fromm et al. (1990) Biotechnology 8:833 839 (maize); Hooykaas-Van Slogteren et al. (1984) Nature (London) 311:763-764; U.S. Pat. No. 5,736,369 (cereals); Bytebier et al. (1987) Proc. Natl. Acad. Sci. USA 84:5345-5349 (Liliaceae); De Wet et al. (1985) in The Experimental Manipulation of Ovule Tissues, ed. Chapman et al. (Longman, New York), pp. 197-209 (pollen); Kaeppler et al. (1990) Plant Cell Reports 9:415-418 and Kaeppler et al. (1992) Theor. Appl. Genet. 84:560-566 (whisker-mediated transformation); D'Halluin et al. (1992) Plant Cell 4:1495-1505 (electroporation); Li et al. (1993) Plant Cell Reports 12:250-255 and Christou and Ford (1995) Annals of Botany 75:407-413 (rice); Osjoda et al. (1996) Nature Biotechnology 14:745-750 (maize via *Agrobacterium tumefaciens*); all of which are herein incorporated by reference. "Stable transformation" is intended to mean that the nucleotide construct introduced into a plant integrates into the genome of the plant and is capable of being inherited by the progeny thereof.

The cells that have been transformed may be grown into plants in accordance with conventional ways. See, for example, McCormick et al. (1986) Plant Cell Reports 5:81-84. In this manner, the present invention provides transformed seed (also referred to as "transgenic seed") having a polynucleotide of the invention, for example, an expression cassette of the invention, stably incorporated into their genome.

The present invention may be used for transformation of any plant species, including, but not limited to, monocots and dicots. Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oil palm (*Elaeis guineensis*), poplar (*Populus* spp.), eucalyptus (*Eucalyptus* spp.), oats (*Avena sativa*), barley (*Hordeum vulgare*), vegetables, ornamentals, and conifers.

In one embodiment, the promoters of the invention are used to drive expression of an SBPase coding region. Plants transformed with a construct comprising a promoter of the invention driving expression of a SBPase coding region demonstrated increased plant yield, i.e., biomass and increased seed count.

Now that it has been demonstrated that upregulation of SBPase increases plant yield, other methods for increasing expression of an endogenous SBPase sequence in a plant of interest can be used. The expression of an SBPase gene present in a plant's genome can be altered by inserting a transcriptional enhancer upstream of the SBPase gene present in the plant's genome. This strategy will allow the SBPase gene's expression to retain its normal developmental profile, while showing elevated transcript levels. This strategy will occur through the insertion of an enhancer element upstream of an SBPase gene of interest using a meganuclease designed against the genomic sequence of interest.

Alteration of the expression of an SBPase gene may be achieved through the use of precise genome-editing technologies to modulate the expression of the endogenous sequence. In this manner, a nucleic acid sequence will be inserted proximal to a native plant sequence encoding the SBPase through the use of methods available in the art. Such methods include, but are not limited to, meganucleases designed against the plant genomic sequence of interest (D'Halluin et al (2013) *Plant Biotechnol J* 11: 933-941); CRISPR-Cas9, TALENs, and other technologies for precise editing of genomes (Feng, et al. (2013) *Cell Research* 23:1229-1232, Podevin, et al. (2013) *Trends Biotechnology* 31: 375-383, Wei et al. (2013) *J Gen Genomics* 40:281-289, Zhang et al (2013) WO 2013/026740); Cre-lox site-specific recombination (Dale et al. (1995) *Plant J* 7:649-659; Lyznik, et al. (2007) *Transgenic Plant J* 1:1-9; FLP-FRT recombination (Li et al. (2009) *Plant Physiol* 151:1087-1095); Bxbl-mediated integration (Yau et al. *Plant J* (2011) 701: 147-166); zinc-finger mediated integration (Wright et al. (2005) *Plant J* 44:693-705); Cai et al. (2009) *Plant Mol Biol* 69:699-709); and homologous recombination (Lieberman-Lazarovich and Levy (2011) *Methods Mol Biol* 701: 51-65); Puchta, H. (2002) *Plant Mol Biol* 48:173-182). The insertion of said nucleic acid sequences will be used to achieve the desired result of overexpression and/or altered expression profile of an SBPase gene.

Enhancers include any molecule capable of enhancing gene expression when inserted into the genome of a plant. Thus, an enhancer can be inserted in a region of the genome upstream or downstream of an SBPase sequence of interest to enhance expression. Enhancers may be cis-acting, and can be located anywhere within the genome relative to a gene for which expression will be enhanced. For example, an enhancer may be positioned within about 1 Mbp, within about 100 kbp, within about 50 kbp, about 30 kbp, about 20 kbp, about 10 kbp, about 5 kbp, about 3 kbp, or about 1 kbp of a coding sequence for which it enhances expression. An enhancer may also be located within about 1500 bp of a gene for which it enhances expression, or may be directly proximal to or located within an intron of a gene for which it enhances expression. Enhancers for use in modulating the expression of an endogenous SBPase or homolog according to the present invention include classical enhancer elements such as the CaMV 35S enhancer element, cytomegalovirus (CMV) early promoter enhancer element, and the SV40 enhancer element, and also intron-mediated enhancer elements that enhance gene expression such as the maize shrunken-1 enhancer element (Clancy, M. and Hannah, L. C. (2002) *Plant Physiol.* 130(2):918-29). Further examples of enhancers which may be introduced into a plant genome to modulate expression include a PetE enhancer (Chua et al. (2003) *Plant Cell* 15:11468-1479), or a rice α-amylase enhancer (Chen et al. (2002) *J. Biol. Chem.* 277:13641-13649), or any enhancer known in the art (Chudalayandi, S. (2011) *Methods Mol. Biol.* 701:285-300). In some embodiments, the present invention comprises a subdomain, fragment, or duplicated enhancer element (Benfrey et al. (1990) *EMBO J* 9:1677-1684).

The invention further provides methods for modulating endogenous SBPase in a plant by inserting a promoter of the invention into a plant genome such that it modulates expression of an endogenous SBPase sequence. As indicated above, methods for determining an insertion site for a promoter or enhancer using the sequences provided herein and methods for inserting a promoter or enhancer sequence into a plant genome at a given insertion site are known in the art.

Alteration of SBPase gene expression may also be achieved through the modification of DNA in a way that does not alter the sequence of the DNA. Such changes could include modifying the chromatin content or structure of the SBPase gene of interest and/or of the DNA surrounding the SBPase gene. It is well known that such changes in chromatin content or structure can affect gene transcription (Hirschhorn et al (1992) *Genes and Dev* 6:2288-2298; Narlikar et al (2002) *Cell* 108: 475-487). Such changes could also include altering the methylation status of the SBPase gene of interest and/or of the DNA surrounding the SBPase gene. It is well known that such changes in DNA methylation can alter transcription (Hsieh (1994) *Mol Cell Biol* 14: 5487-5494). It will be obvious to those skilled in the art that other similar alterations (collectively termed "epigenetic alterations") to the DNA that regulates transcription of the SBPase gene of interest may be applied in order to achieve the desired result of an altered SBPase gene expression profile.

Alteration of SBPase gene expression may also be achieved through the use of transposable element technologies to alter gene expression. It is well understood that transposable elements can alter the expression of nearby DNA (McGinnis et al (1983) *Cell* 34:75-84). Alteration of the expression of a gene encoding SBPase in a photosynthetic organism may be achieved by inserting a transposable element upstream of the SBPase gene of interest, causing the expression of said gene to be altered.

Alteration of SBPase gene expression may also be achieved through mis-expression of a transcription factor or transcription factors that regulate the expression of the SBPase gene of interest. It is well understood that alteration of transcription factor expression can in turn alter the expression of the target gene(s) of said transcription factor (Hiratsu et al (2003) *Plant J* 34:733-739). Alteration of SBPase gene expression may be achieved by altering the expression of transcription factor(s) that are known to interact with the SBPase gene of interest (e.g., the WF-1 transcription factor; Miles et al (1993) *Plant Mol Biol* 22: 507-516).

Alteration of SBPase gene expression may also be achieved through the insertion of a promoter upstream of the open reading frame encoding the native SBPase in the plant species of interest. This will occur through the insertion of a promoter of interest upstream of an SBPase open reading frame using a meganuclease designed against the genomic sequence of interest. This strategy is well-understood and has been demonstrated previously to insert a transgene at a predefined location in the cotton genome (D'Halluin et al (2013) *Plant Biotechnol J* 11: 933-941). It will be obvious to those skilled in the art that other technologies can be used to achieve a similar result of insertion of genetic elements at a predefined genomic locus (e.g., CRISPR-Cas9, TALENs, and other technologies for precise editing of genomes).

The following examples are offered by way of illustration and not by way of limitation.

EXPERIMENTAL

Example 1—Construction of Plant Transformation Vectors

The cDNA encoding the SBPase protein from *Brachypodium distachyon* (Genbank Entry XM_003564577; SEQ ID NO: 2) was codon-optimized, resulting in the open reading frame of SEQ ID NO: 1. This open reading frame was de novo synthesized with appropriate restriction sites added at the 5' and 3' termini to facilitate cloning.

Rice promoters that drive developmentally regulated expression were de novo synthesized with appropriate restriction sites at their 5' and 3' termini to facilitate cloning. The promoter from rice locus Os12g19470 (SEQ ID NO: 4), the promoter from rice locus Os01g45274 (SEQ ID NO: 3), the promoter from rice locus Os07g37240 (SEQ ID NO: 5), the promoter from rice locus Os08g10020 (SEQ ID NO: 13), the promoter from rice locus Os12g17600 (SEQ ID NO: 15), the promoter from rice locus Os02g10390 (SEQ ID NO: 17), the promoter from rice locus Os04g56400 (SEQ ID NO: 19), and the promoter from rice locus Os01g40310 (SEQ ID NO: 21) were de novo synthesized. In addition, the CaMV 35S promoter (SEQ ID NO: 9) was de novo synthesized and fused to the 5' untranslated region (5'UTR) from the maize ubiquitin gene (SEQ ID NO: 10). The maize ubiquitin promoter (SEQ ID NO: 12) was also de novo synthesized.

Rice 3' untranslated regions (3'UTRs) were de novo synthesized with appropriate restriction sites at their 5' and 3' termini to facilitate cloning. The 3'UTR from rice locus Os12g19470 (SEQ ID NO: 6), the 3'UTR from rice locus Os01g45274 (SEQ ID NO: 7), the 3'UTR from rice locus Os07g37240 (SEQ ID NO: 8), the 3'UTR from rice locus Os08g10020 (SEQ ID NO: 14), the 3'UTR from rice locus Os12g17600 (SEQ ID NO: 16), the 3'UTR from rice locus Os02g10390 (SEQ ID NO: 18), the 3'UTR from rice locus Os04g56400 (SEQ ID NO: 20), and the 3'UTR from rice locus Os01g40310 (SEQ ID NO: 22) were de novo synthesized. In addition, the 3'UTR from the maize ubiquitin gene (SEQ ID NO: 11) was de novo synthesized.

Using standard molecular biology protocols, the codon-optimized SBPase open-reading frame (ORF) was cloned in between the promoter and 3'UTR of the rice genetic elements described here. The vectors contain the genetic elements described in Table 1. These transgene cassettes were cloned into a modified pMDC99 binary vector backbone.

TABLE 1

Vectors for SBPase overexpression

| Vector | Promoter | ORF | 3'UTR |
|---|---|---|---|
| 130005 | ZmUbi (SEQ ID NO: 12) | SBPase (SEQ ID NO: 1) | ZmUbi (SEQ ID NO: 11) |
| 130006 | CaMV 35S (SEQ ID NO: 9) | SBPase (SEQ ID NO: 1) | ZmUbi (SEQ ID NO: 11) |
| 130007 | Os08g10020 (SEQ ID NO: 13) | SBPase (SEQ ID NO: 1) | Os08g10020 (SEQ ID NO: 14) |
| 130008 | Os12g19470 (SEQ ID NO: 4) | SBPase (SEQ ID NO: 1) | Os12g19470 (SEQ ID NO: 6) |
| 130009 | Os01g45274 (SEQ ID NO: 3) | SBPase (SEQ ID NO: 1) | Os01g45274 (SEQ ID NO: 7) |
| 130010 | Os12g17600 (SEQ ID NO: 15) | SBPase (SEQ ID NO: 1) | Os12g17600 (SEQ ID NO: 16) |
| 130011 | Os07g37240 (SEQ ID NO: 5) | SBPase (SEQ ID NO: 1) | Os07g37240 (SEQ ID NO: 8) |
| 130012 | Os02g10390 (SEQ ID NO: 17) | SBPase (SEQ ID NO: 1) | Os02g10390 (SEQ ID NO: 18) |
| 130013 | Os04g56400 (SEQ ID NO: 19) | SBPase (SEQ ID NO: 1) | Os04g56400 (SEQ ID NO: 20) |
| 130014 | Os01g40310 (SEQ ID NO: 21) | SBPase (SEQ ID NO: 1) | Os01g40310 (SEQ ID NO: 22) |

Example 2—Transformation of *Brachypodium distachyon*

The vectors described in Table 1 were transformed into *Agrobacterium tumefaciens* (strain AGL-1). The resulting *Agrobacterium* cells were used to insert the SBPase transgene cassettes into the *B. distachyon* nuclear genome. Transgenic plants were cultivated and the presence of the appropriate transgene cassette was confirmed by PCR.

Transgenic *B. distachyon* plants containing the SBPase transgene cassette, as confirmed by PCR, were grown to maturity and allowed to self-pollinate to produce T1-generation seeds.

Example 3—Cultivation of T1-generation *B. distachyon* Plants

T1-generation *B. distachyon* plants were grown from seed in the same conditions as wild-type (WT) *B. distachyon* plants in a growth chamber under a 20-hour light/4-hour dark photoperiod. All plants were allowed to mature and self-pollinate, and the above-ground biomass was then dried in a 37° C. oven. The seeds were separated from the remainder of the biomass. Total above-ground biomass was weighed, and the number of seeds was counted. The resulting biomass and seed counts are shown in Table 2.

TABLE 2

Weight of above-ground biomass and number of seeds from T1-generation 130005, 130006, 130008, 130009, and 130011 plants, as well as from wild-type (WT) *B. distachyon* plants.

| Construct | Plant Weight (g) | Seed Count |
| --- | --- | --- |
| 130005 | 1.79 ± 0.77 | 291.40 ± 170.69 |
| 130006 | 3.31 ± 0.72 | 733.30 ± 237.51 |
| 130008 | 3.03 ± 1.24 | 697.55 ± 369.80 |
| 130009 | 2.90 ± 1.79 | 555.83 ± 310.80 |
| 130011 | 3.71 ± 1.46 | 775.22 ± 541.93 |
| WT | 1.19 ± 0.60 | 249.25 ± 123.03 |

Example 4—Quantification of SBPase Protein Accumulation From Developmentally-Regulated Promoters T1-generation *B. distachyon* plants transformed with the 130008 and 130009 vectors were grown alongside wild-type *B. distachyon* plants in a 16 hour light/8 hour dark light cycle. Leaf samples were collected at various timepoints (ranging from 50 days to 93 days after planting) during the plants' development and were flash-frozen in liquid nitrogen. Protein was extracted from the flash-frozen leaf samples in TBST buffer. Total protein concentration was determined using a standard Bradford assay (Boston Bioproducts, Ashland, Mass.) with a standard curve constructed from known amounts of bovine serum albumin protein. Following the determination of total protein concentration in the leaf extracts, 50 µg of total protein was tested for SBPase content by an ELISA assay. For these ELISA assays, the protein was allowed to bind to high-binding, clear 96-well plates (Greiner Bio-One, Germany) overnight (approximately 16 hours) at 4° C. Following this binding period, all wells were washed three times in TBST buffer then incubated for one hour at room temperature (approximately 25° C.) with a primary antibody generated against recombinant SBPase produced in *E. coli*. All wells were then washed three times in TBST buffer then incubated for one hour at room temperature (approximately 25° C.) with a secondary antibody conjugated to horseradish peroxidase (Thermo Scientific, Rockford, Ill.). Following three washes in TBST buffer, ABTS detection buffer (Thermo Scientific, Rockford, Ill.) was added. This was allowed to incubate for 30 minutes at room temperature, and then the absorbance of all wells was read at 405 nm. SBPase concentration was determined based on a calibration curve containing known amounts of purified SBPase protein produced in *E. coli*. These ELISA assays revealed that the Os12g19470 and Os01g45274 promoters in constructs 130008 and 130009, respectively, drove SBPase gene expression and protein accumulation in a developmentally-regulated manner, such that SBPase protein levels in the transgenic *B. distachyon* lines were generally similar to SBPase protein levels in wild-type plants for most of the developmental timepoints tested, with the exception of the 78-day timepoint, when the transgenic plants consistently showed higher SBPase levels than wild-type plants.

Example 5—Alteration of SBPase Expression

The expression of an SBPase gene present in a higher plant's genome is altered by inserting a promoter upstream of the SBPase gene present in the higher plant's genome. The SBPase gene shows the developmental expression profile associated with the promoter of interest. A meganuclease is designed to cleave the genomic DNA at a site upstream of the SBPase open reading frame. This site is chosen such that insertion of the promoter improves transcription of the downstream sequences. Meganuclease-driven cleavage of the genomic DNA is used to guide insertion of the promoter of interest. A transformation construct is designed so that the promoter of interest is flanked DNA that matches the genomic DNA upstream and downstream of the meganuclease cleavage site. This flanking DNA is used to guide homologous recombination for insertion of the promoter of interest at the desired site. In this way, one or more of the promoters selected from the group of SEQ ID NOs: 3, 4, 5, 13, 15, 17, 19, and 21 is inserted upstream of the SBPase gene to drive expression of the SBPase gene.

Alternatively, the entire native SBPase promoter in the plant genome is replaced by a promoter of interest. One or more meganucleases are designed to cleave the genomic DNA upstream and downstream of the native SBPase promoter. These cleavages are used to guide insertion of the promoter of interest at the desired site in the genome such that the promoter of interest replaces the native SBPase promoter. The promoter of interest is flanked by DNA that is homologous to the genomic DNA that is upstream and downstream of the two meganuclease cleavage sites such that the flanking DNA can guide homologous recombination. In this way, one or more of the promoters selected from the group of SEQ ID NOs: 3, 4, 5, 13, 15, 17, 19, and 21 is inserted upstream of the SBPase gene to drive expression of the SBPase gene.

Example 6—Transformation of *Oryza sativa*

Vectors 130005, 130006, 130007, 130008, 130009, 130010, 130011, 130012, 130013, and 130014 were transformed into *Agrobacterium tumefaciens* (strain AGL-1). The resulting *Agrobacterium* cells were used to insert the SBPase transgene cassettes into the *O. sativa* nuclear genome. Transgenic plants were cultivated and the presence of the appropriate transgene cassette was confirmed by PCR.

Transgenic plants containing the SBPase transgene cassette, as confirmed by PCR, were grown to maturity and allowed to self-pollinate to produce T1-generation seeds.

Example 7—Transformation, Cultivation, and Characterization of *Setaria viridis*

Vectors 130005, 130006, 130007, 130008, 130009, 130010, 130011, 130012, 130013, and 130014 were transformed into *Agrobacterium tumefaciens* (strain AGL-1). The resulting *Agrobacterium* cells were used to insert the SBPase transgene cassettes into the *S. viridis* nuclear genome. Transgenic plants were cultivated and the presence of the appropriate transgene cassette was confirmed by PCR.

Transgenic plants containing the SBPase transgene cassette, as confirmed by PCR, were grown to maturity and allowed to self-pollinate to produce T1-generation seeds.

T1-generation seeds are planted to cultivate the resulting T1-generation plants. The T1-generation plants are grown alongside suitable control plants to assess the phenotypic and developmental effects of SBPase expression on the transgenic *S. viridis* plants. Leaf samples are collected from the *S. viridis* plants and total RNA is extracted from the leaf tissue. Quantitative RT-PCR is performed using this RNA and primers designed against the SBPase transgene cassette. The primers are designed to amplify a region that spans from the 3' region of the SBPase open reading frame into the 3'UTR downstream of the SBPase gene to avoid amplification of the native *S. viridis* SBPase transcript. The results of these quantitative RT-PCR experiments show the expression levels of the SBPase transgene when driven by the promoter of interest.

Example 8—Alteration of the Expression of Photosynthetic Genes Using Developmentally-Regulated Promoters It will be obvious to one skilled in the art that the methods described in the above Examples may be used to alter the expression of other genes involved in photosynthesis beyond sedoheptulose-1,7-bisphosphatase (SBPase) genes. Based on the data obtained for driving SBPase expression in plants by the developmentally-regulated promoters described herein, it would be anticipated that these same promoters would be of utility for additional genes involved in photosynthesis. These genes include, but are not limited to, fructose-1,6-bisphosphatase (FBPase) (SEQ ID NOs: 23-24, 104-125), fructose-1,6-bisphosphate aldolase (FBP aldolase) (SEQ ID NOs: 25-26, 126-155), transketolase (SEQ ID NOs: 27-28), the Rubisco small subunit (SEQ ID NOs: 29-30), the Rubisco large subunit (SEQ ID NOs: 31-32), Rubisco activase (SEQ ID NOs: 33-34), the ADP-glucose pyrophosphorylase (AGPase) large subunit (SEQ ID NOs: 35-36, 156-199), the AGPase small subunit (SEQ ID NOs: 37-38, 200-221), carbonic anhydrase (SEQ ID NOs: 39-40, 222-268), PEP carboxylase (PEPC) (SEQ ID NOs: 41-42), pyruvate phosphate dikinase (PPDK) (SEQ ID NOs: 43-44), malate dehydrogenase (SEQ ID NOs: 45-46), malic enzyme (SEQ ID NOs: 47-48), phosphoglycerate kinase (SEQ ID NOs: 49-50), glyceraldehyde 3-phosphate dehydrogenase (SEQ ID NOs: 51-52), triose phosphate isomerase (SEQ ID NOs: 53-54), ribulose 5-phosphate isomerase (SEQ ID NOs: 55-56), phosphoribulokinase (SEQ ID NOs: 57-58), and ribulose 5-phosphate 3-epimerase (SEQ ID NOs: 59-60).

One or more of the photosynthetic genes described in this example is cloned into a vector that is suitable for plant transformation. The photosynthetic gene or genes are placed downstream of one of a promoter of interest that is used to drive expression of said photosynthetic gene or genes. One or more of the promoters selected from the group of SEQ ID NOs: 3, 4, 5, 13, 15, 17, 19, and 21 is placed upstream of an open reading frame encoding a photosynthetic protein of interest in a plant transformation vector. This plant transformation vector is used to transform a plant cell, from which a plant is regenerated. Expression of the photosynthetic gene is driven by the promoter of interest in the resulting regenerated plant. Plants expressing the photosynthetic gene or genes of interest are grown alongside suitable control plants to assess the effects of photosynthetic gene expression.

Example 9—Quantifying SBPase Transcript Levels in Transgenic *B. distachyon* and Transgenic *O. sativa*

T1-generation *B. distachyon* plants transformed with one of the vectors shown in Table 1 were cultivated, and leaf samples were collected from the growing plants. Total RNA was extracted from the leaf samples and this RNA was used for quantitative RT-PCR experiments. Primers were designed to specifically amplify the native *B. distachyon* SBPase gene (SEQ ID NOs: 63-64), to amplify the SBPase transgene (SEQ ID NOs: 65-76), or to amplify the *B. distachyon* ubc18 gene (SEQ ID NOs: 61-62). The ubc18 gene is a constitutively expressed gene and is used as a control reaction for quantitative RT-PCR experiments. These quantitative RT-PCR experiments resulted in the data shown in Table 3.

TABLE 3

SBPase Expression levels in transgenic *B. distachyon*

| | Expression Level |
|---|---|
| Native SBPase | 1.1 |
| 130006 | 7.8 |
| 130008 | 0.5 |
| 130009 | 0.5 |
| 130011 | 1.5 |

Expression levels in Table 3 are shown relative to the *B. distachyon* ubc18 gene expression levels. The expression of the native SBPase gene was unaffected in transgenic plants and hence the expression levels of the native SBPase gene are averaged across all wild-type and transgenic plants tested. Expression levels indicated in Table 3 for transgenic *B. distachyon* 130006, 130008, 130009, and 130011 plants are for the SBPase transgenes only.

T1-generation *O. sativa* plants plants transformed with one of the vectors shown in Table 1 were cultivated, and leaf samples were collected from the growing plants. Leaf samples were collected as the leaves emerged from the whorl, using a protocol modified from Wang et al. (2014) Nat Biotechnol 32:1158-1165. The leaves were segmented into five segments of equal length and total RNA was extracted from each segment. This RNA was used for quantitative RT-PCR experiments. Primers were designed to specifically amplify the native *O. sativa* SBPase gene (SEQ ID NOs: 77-78), to amplify the SBPase transgene (SEQ ID NOs: 65-76), or to amplify the *O. sativa* ubq5 gene (SEQ ID NOs: 79-80). The ubq5 gene is a constitutively expressed gene and is used as a control reaction for quantitative RT-PCR experiments. These quantitative RT-PCR experiments resulted in the data shown in Table 4.

TABLE 4

SBPase Expression levels in transgenic *O. sativa*

|  | Segment 1 | Segment 2 | Segment 3 | Segment 4 | Segment 5 |
|---|---|---|---|---|---|
| Native SBPase | 0.0039 | 0.12 | 0.53 | 0.96 | 0.97 |
| 130009 | 0.027 | 0.071 | 0.14 | 0.15 | 0.14 |
| 130014 | 2.41 | 4.49 | 3.19 | 2.99 | 2.67 |

Expression levels in Table 4 are shown relative to the *O. sativa* ubq5 gene expression levels. Leaves were segmented such that Segment 1 is at the leaf base and Segment 5 is at the leaf tip. The expression of the native SBPase gene was unaffected in transgenic plants and hence the expression levels of the native SBPase gene are averaged across all wild-type and transgenic plants tested. Expression levels for 130009 and 130014 plants indicated in Table 4 are for the SBPase transgenes only.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (268 sequences)

SEQ ID NO: 1 - DNA, 1176 bp, Brachypodium distachyon
  misc_feature (1)...(1176): Codon-optimized SBPase ORF
atggagaccgtggccgcctccggctacgccaggggcgccgccaccaggtccccggcctgctgcgccgccatgtccttctcccagtcctacaggccgaaggccgccaggccgccgaccaccttctacggcgagtccgtgagggccaacaccgccaggaccctcccgggcaggcagtccaaggccgcctccagggccgccctcaccaccaggtgcgccatcggcgactccctcgaggagttcctcaccaaggccaccccggacaagaacctcatcaggctcctcatctgcatgggcgaggccatgaggaccatcgccttcaaggtgaggaccgcctcctgcggcggcaccgcctgcgtgaactccttcggcgacgagcagctcgccgtggacatgctcgccgacaagctcctcttcgaggccctcgagtactcccacgtgtgcaagtacgcctgctccgaggaggtgccggagctccaggacatgggcggcccggtggacggcggcttctccgtggccttcgacccgctcgacggctcctccatcgtggacaccaacttcaccgtgggcaccatcttcggcgtgtggccgggcgacaagctcaccggcgtgaccggcggcgaccaggtggccgccgccatgggcatctacggcccgaggaccaccttcgtggtggccctcaaggactgcccgggcacccacgagttcctcctcctcgacgagggcaagtggcagcacgtgaaggacaccaccaccatcggcgagggcaagatgttctccccgggcaacctcagggccaccttcgacaacccggactacgacaagctcgtgaactactacgtgaaggagaagtacaccctcaggtacaccggcggcatggtgccggacgtgaaccagatcatcgtgaaggagaagggcatcttcaccaacgtgacctccccgaccgccaaggccaagctcaggctcctcttcgaggtggccccgctcggcttcctcatcgagaaggccggcggccactcctccgacggcaagcagtccgtgctcgacaaggtgatcaccgtgctcgacgagaggacccaggtggcctacggctccaagaacgagatcatcaggttcgaggagaccctctacggctcctccaggctcgccgccggcgccaccgtgggcgccaccgtgtga

SEQ ID NO: 2 - protein, 391 aa, Brachypodium distachyon
  DOMAIN (1)...(391): SBPase
METVAASGYARGAATRSPACCAAMSFSQSYRPKAARPPTTFYGESVRANTARTLPGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVITVLDERTQVAYGSKNEIIRFEETLYGSSRLAAGATVGATV

SEQ ID NO: 3 - DNA, 1412 bp, Oryza sativa
  misc_feature (1)...(1412): Os01g45274 promoter
atcttggctatttcccatggcttctccgctctactcttgtccctgtttggatgacgccgtccagaccaagacatcaaaacggggcgacactgtgaggttacggtgtcgccattcgccacaatgagctcaccatgtcaccttgtcgacatttcgccgcatacaagtcgctgtgcgaccgccaggtgggccccactgtgagcagcacgagtgtggcgcgtatataaatttgtcggatggagaggcagctgaaggtttttcgccatggcaactgcgtccttcgacatctgcgcgaaggttgggctcggaatttcgacaggatactcacagcgaaatcaatactctgctatggcaaatggtacgcactcgtttcgattgttctgccttcttctgttttattttttttcccgtatgtagctgtagctgctgataaacgtgccatgtattccatctcgttcttgcaagcagtttcttagatgagttaaaatatgtattccatgtcaactgttcactttagttaggtagaactttcttacattatgattagttatctacttactctctctgtccgataataattatcgcattgattttttttataatgtttgatcattcgtcttattaaaaaaaattatagaattattttttttattttgtttgtgacttgctttattatcaaaaaaataatttaaatatggcatatctttttttatatttacaataatttttcaaaaaagatgaatggtcaaacgttacacgaaaaaatcaaagcgaccactattttggaatggaagtagtacctgtagagaaaaattaaatattagttcttaagtgagtgtggaccgaaaaaattccttatttatcataaacacgttttccaaacttttaaatgatatgtttttttaaatatataaatgaacatgttctttcaaaaatcaaataaatcactttttcaagtttgtactgattaatactagactaatcatttgctaattgtttatattgttttacttgccatcataactcatgccaaattgcttttccaaacccaccattagccgctgtggcaagctcagttgctagcttgaggaggactatacaaagttgcacacacgccatggtactaacgagaactggaaaatatgttgactggaaaaattgtatcagttcatattagaaacaaattactgtcagaatgaggaaaaactcagtccatgccactaaaggcatcagatgcgaattggcgctcctttctcctttcaaggagtaggcataaacataggctctgcagtagtttcatctgagacagtcggcacgcgggggcgcgggcgtctatttgttgcgcgcgcgggcgcggcggcgagacgcgtgtgtagctactgctataaggagcgcgccgtgcaccgcctctcaca

SEQ ID NO: 4 - DNA, 1493 bp, Oryza sativa
  misc_feature (1)...(1493): Os12g19470 promoter
gaaccatacggaattgacggaccaattgtgcatacggacttagctaaaataattgttgatttttggcaataagaaaagcgagtagcacataaaatctaaagtggatgagtaaagggacaaaattttatacatgttcaggccttctcgatgagaagtaatactatactcctgttttggggattatatttgtcagatgttgtatcaatctgacgatcgagttatggttattgttggcggctgttaaatatcgattttatgccatcaatacctgtataatttatacagaaataataaaacattcaacatagtggtaggctttaattctaacatattccataagtgttggtgtatatttggatgcaggtaataaaccaccgaattaggaggaaatctagactaagttgaaggaaattttcatccatacaagtgttgggctttttaactccattttaacaccaaaatgcaagcccaaaaacctgcgaaatggataaggcagactgagaaggaggcccaggccaaaacttgggccagttgggccaagccaggtttcggccaaatcctgatcatcgctgttgatctcagggtttggcatggacgctcttgatttactcctgatggcagttgcagggcatttccgatcattcgcatgctctacaaccatcatacctacttatttaaggagctctcatcctcacttcatatcacacactccaatcttgagctgaattataagaggctctattgtattttattgtatactagaattagggaaagattaaggtcgtagaagaaatcggaggaattccggagttatcggtgatccttttctatttcttatactttgttatttgctttaatagaaatatcatttcaagtaattaagatttgtttagtgagaactattattggctagttcctaattagcgtatgagatcactgttcactataatccgttaaaatatagtgattgctttagtgagttacaaacactacagtagttattgattgcttaaacgtggtgtttagatagttaatttctagtggttgctgcgtatcccatagtacgttagaggcgggtgtagaggtggtgaccgccctcaagagcacttaattcctccttgtttgtgtacgtggtagagcgacatctgggaacagtgggttaccagtgcctgaagtaccatgttaggattaaaattgtaacattgtttctcattagtaaatcttctctaccctctacccacatttgctttgtatccttggtgaacctgaagaggaactgaacacacacgttccatgaggaagacactcagtactcaagccggaggcagcacactgcaacttaagtttttctatagctcctagcaagctagcaatggctccctcggtgatggcttcgtcggccacctccgtggctcccttccaggggctcaagtccactgcgggcctcccggtgaaccgccgctccagcagctcgagctttggcaacgtcagca

SEQ ID NO: 5 - DNA, 1414 bp, Oryza sativa
  misc_feature (1)...(1414): Os07g37240 promoter
atgtgatcaactgacaattcaagtttgtgatggtttctattatttatgatgtttcttaagccagaataggaaatagcactaaggaggttcgagttcagttttggcttctaacttagtaccaatgttgggggcatatctggacttttctgtgggaggactcattggagatagggagattccatacaggataaaactccaaaagcattcttgaggcattctagtatagtacaagtcaagtaattttttcagtgtccaatgataatttcaggaaacatttaagccagttatgtttgtcatttggtgaactcaaaatgtaatgtgcactttgatgttacctacttacctcactaatattttcaatggcttccttgacagctttgcgctgctctaaacatcaacaaaagaagtgtcgacagggatctcgatgtttaccggaacatactctccaaattggtccaggctaaggaacttctcaaggaatacgtggaaaggtaaccaacttatccgctgatttcccacttctcttactgcccaaaccctgatttgttcaatcactgatattactaacgcacgagggatgttcctaattttattttgcaacaattgtgtgatattaatagctttatacttgaagtttactgtttagcacataaatctctcctctttcaatgagcccaggcaaatggattagtttatattgccttctctttacattttgtatcctccccagtttttctgtgttaaactgatcatctcaacgagttgaactcaactttgttggcagggaaaagaagaagagagaggaaagatcagagaccccaaaatcgaatgaagctgttacgaaatttgacgggagtctcaattccatgaggcattaactcaagccttcataaggggagtgagtgctaccgtggataacagattttaacagagttctggatcacgttgagaaactatcaaggtcacctttcactgcacggacactttggctgctctcgtgtggttttgtattctgccgtataaaaggatccagattgttcttactactgagcattatattttttttgtaattctccttttcagtgttcaaatgtatcgttttccttttctttgacaatatatgaagaggtatgtggggatcaatgttactcacaagatgaaaaatatattgttcagttatctcttcatgatgaaaatgaaatcggtcacaagttctttctttggatctgtatgtatcaggaatatcagtggtggaaacgagcaggaagacttttctgcattggatcatatgccagaaaatcgcgaagggcagggcattggtaacctccttaccttggacacctgcggatgacagaaccccccctcaccaccacccacacattctcgaagaaggagaagaaggagaggagcagcc

SEQ ID NO: 6 - DNA, 1424 bp, Oryza sativa
  misc_feature (1)...(1424): Os12g19470 3'UTR
gcgctttcgttccttcgtgcatgttctttctttttcttttttttttgtgtgtccgtgttaagctgcacgtaattgttctctcgcgctccgacctgccgttgttgcaagagtactactacaactatcggtctatcgttcggtgacggtgagacagggcacgtgaatgcaagatctccggctatacacacgtactcatgtaatatgatgcctagagcatatctgaatccgtcgacaatgaaattttggttttgcaaaatgctggtatttgtttatcatcctggcacgtgatatttgcctagagcatctaaatcacttttacgaaatgtgcgcgtcaacaaactgatacggcccaaatgccagaaattaccagcatatatagccatatcaacttttgattcgtatatatgaaggttgatttagttagagaaattcggttgtgagagaaggaggctagcaaagattcggttgatcaagctgtaccgccaggccaggacgtgctgtgcgcgcggctgtgccgcttgaccgcagaaccatacggaattgacggaccaattgtgcatacggacttagctaaaataattgttgatttttggcaataagaaaagcgagtagcacataaaatctaaagtggatgagtaaagggacaaaattttatacatgttcaggccttctcgatgagaagtaatactatactcctgttttggggattatatttgtcagatgttgtatcaatctgacgatcgagttatggttattgttggcggctgttaaatatcgattttatgccatcaatacctgtataatttatacagaaataataaaacattcaacatagtggtaggctttaattctaacatattccataagtgttggtgtatatttggatgcaggtaataaaccaccgaattaggaggaaatctagactaagttgaaggaaattttcatccatacaagtgttgggctttttaactccattttaacaccaaaatgcaagcccaaaaacctgcgaaatggataaggcagactgagaaggaggcccaggccaaaacttgggccagttgggccaagccaggtttcggccaaatcctgatcatcgctgttgatctcagggtttggcatggacgctcttgatttactcctgatggcagttgcagggcatttccgatcattcgcatgctctacaaccatcatacctacttatttaaggagctctcatcctcacttcatatcacacactccaatcttgagctgaattataagaggctctattgtattttattgtatactagaattagggaaagattaaggtcgtagaagaaatcggaggaattccggagttatcggtgatccttttctatttcttatactttgttatttgctttaatagaaatatcatttcaagtaattaagatttgtttagtgag

SEQ ID NO: 7 - DNA, 310 bp, Oryza sativa
  misc_feature (1)...(310): Os01g45274 3'UTR
atccgaccgtccgtccgttcagttcgtcagtttacgccaacgcttttgcataagtactacctgaggatatcgtccccgatcatcgatgtgaacgcgtggagtactactacgtacgtaccggatggttcgatatatgtgaatgctgtattaagtaataacaagaaatatatctcctctactttttcctgacgcggagttgtactgcctatgatgcataatttgatcgcagtgtgatcaaaagacatcagctataatgtcttaataatattattatgaagagtttacctttttactaccttttactctggta

SEQ ID NO: 8 - DNA, 363 bp, Oryza sativa
  misc_feature (1)...(363): Os07g37240 3'UTR
tttaagctctttcgcgcgcaattcaaacgggatcgatgcgttggtgtgcgttcgcgcgcgctgtttagttttgtgatgacgagcgagctgggagggtatggagagaggagaggtcatccttttgttgattactacttaaattaggaaagctgggttggtggttaatggcgacttgcatggtggtgatttgtaatataagaacacccaagatgatgaattaatgcatccacttgtacatcgatcgatcgatcttggtatttgactaagtgagtgtgactgtgaatgcacatatgcacactgcatagactttacctgacatgtattgatattaataaagttataacaggtgtctcgctatcaata

SEQ ID NO: 9 - DNA, 769 bp, Cauliflower Mosaic Virus
  misc_feature (1)...(769): 2X 35S CaMV 35S promoter
aagcttgcatgcctgcaggtcaacatggtggagcacgacactctcgtctactccaagaatatcaaagatacagtctcagaagaccagagggctattgagacttttcaacaaagggtaatatcgggaaacctcctcggattccattgcccagctatctgtcacttcatcgaaaggacagtagaaaaggaagatggcttctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatggtcaacatggtggagcacgacactctcgtctactccaagaatatcaaagatacagtctcagaagaccagagggctattgagacttttcaacaaagggtaatatcgggaaacctcctcggattccattgcccagctatctgtcacttcatcgaaaggacagtagaaaaggaagatggcttctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagg

SEQ ID NO: 10 - DNA, 157 bp, Zea mays
  misc_feature (1)...(157): Ubiquitin 5'UTR
attcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaag

SEQ ID NO: 11 - DNA, 623 bp, Zea mays
  misc_feature (1)...(623): Ubiquitin 3'UTR
gtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgat

SEQ ID NO: 12 - DNA, 2161 bp, Zea mays
  misc_feature (1)...(2161): Ubiquitin promoter
actatgaagaagcacaaagaatacgagggatggtgcagagccgaagctatgcgcaaaagagcttcggcgtgataacagaaaaggaaaccgacttaaaggggaaaagactatttagaccccgatgggttactatagagttattagcaaatgtaaagggcataggtgtaattttacatgggctgcgtctcgtgcctataaatagatgaacagtgctcccgtactgttcacacggactggacatttgcttttgcgtcacgcttgtacttttggcttttttcaagccgaaggtacatttgtaatttgttatcatttctatttttccataataataaaatagaaatgagttaacgataatatttgaggatttatgttattcatactttgcatgaatcctttttcattatttgtggtattgatgaaggtatgcccttcataacctttgtccaagactcattatatcccgagggagataatgtttcaaaggacgaaagactttaacgtttaacaatttctgtgttgccttgttcttaattcatagcatttaaggacaagttcccaacacatataacatggtgaatagacgcatgccacaactctggttttgcaagaacattaaaacaatggttttagagaggatggtataccatagtactcaatgataaaggttttttagttagttgagctccagaattcatagttaacagttaacacttaacaataatactacgcctgtaccacttgttcatcatcagaattcagaaggaaaggtgagcggggaacccttttgtgacttctttttgtgatcagctagccggtgatggtggtaccatcagtggccagcttttgttctagttcaacggtcccggccttccggccacctaatgcaccaactattagtattgcagctagccttcaaaagaaatgcatttgcagccgcctgtccctgtccccgaccaatctgctagcagactcgcattatcgatggaggacactaataaattcagccttcgatgtggatgcaacagcttcacaggattccattaaatcgtagccgttgtgtcaaagtttgctttgccaacgttatttatttatttatttagaaaaccagctttgaccagccgccctctttacgtttggcacaatttagctgaatccggcggcatggcaaggtagactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacggggggacaattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaag

SEQ ID NO: 13 - DNA, 1516 bp, Oryza sativa
  misc_feature (1)...(1516): Os08g10020 promoter
cttgcgattgtttccgctggatataaggactacgctaatatttaactttagaagttaattattttagtaaaactcacttagctgtcatctcctttgaacttccacttcaattcagattttagagccatggcctaccaaacaggccctacattttccagataggttccattgctcaatgtttttttggctcaaatttcttaatctcatcgttggcaggagcctttggcatgttctcagatttggtttgttatcaactgtgtattgtaggcaattttggtcatagcaacactgggtacaaacttgtactcaagcaagagttacaattgacaacatgagtacattgactagggcgtgcagtttttttagatggttagggcatgcagttgccactggtgcaacgtaatagttggagtctcctttgtaaatagaggatacgagattctgaatttttgtagcaaatagtcaatgattttttcacccttgtgtagatgagtggcattcgcatgttctgtattcttgaggataaatttcaacggttttcttctgaaatgcagaatatgtggtcttgttggtaaactgttgtcttggactagtccatgctatgcaattttgagcaattcgcatctggttgtaaaccgatatattctatgggttgtgtttacgaacgtgactattgttgagataatatgatgtcattatctttgtttatcttctgtggttcgaaccaaacattactaacagaactactccgtgatatgttatttgtgaaagcaatattcatagttgcaaacataagctagtgagatgcacagtaactagttatcaaaacgaaaaagaggctagctgactctgctcgtcatgcatgatatgtatgaatttttgtaggttactactgatatcagttcatcgatgctgcatcatgcatgaactgcaggttactactgatattgttttgggcattagcaggtttcagaattgaactttcgactgttgctgcgcgcacacaaaataaccttcactgcaaaaatttagtatgacgtatttgcaactactggtaaactcatattgtcacgttagcattatccgagacaaatctatgcttttcaggttaataagctaaatatttcagaaaacgtataataataacagttactccggtgattttggaaatttgactacggtgacgacttgttatcttgatcgaaatgagcgccgtatgaatcccttcttcggacttttgagtttacagagcagctgctgatggaagcaaacctgaggtaaatactgaggagctttgctctgacaacgtggcgcgccggcggtcacacctgtgctggtgcaccctggcattatccccatccaccatcctgtgggtgactggccaccaaaggtttttggcgccacaattatattgagctgccattgcttctcacctctgctttgcatccatccatccatcagagatcaggtagaacagtgagagtgaggtgcagaaaaatttgagctgaagctgagg

SEQ ID NO: 14 - DNA, 319 bp, Oryza sativa
  misc_feature (1)...(319): Os08g10020 3'UTR
tctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatacttgaatttggagattaattgttgatactaaatacatagattacataaggttatcttgcatta

SEQ ID NO: 15 - DNA, 1585 bp, Oryza sativa
  misc_feature (1)...(1585): Os12g17600 promoter
gcttgttaaaatgcctgcaaggagggagagagaaaggaaggtgggggagggatggggcactggtgcggctggcatgtggggtccagggctcctgggctcaccgctcagagaggaggagaagaaagagaggagaggcgattttcctgaaaattttggtgaaaactgagagtgtgatcgaattttcaggatatgctacagtgtagcaaacacctgtgcatagataactgggaataaatgcgatcatgaacttcttttggtgaatttttgagacttttgtcatgtgtacttctgtgaaaattcagagaagttcactgtttcatttcaatttgaactggtttcgattgttttgacatatttaattgacgtgcaaaactaaggtacaaagttgtcaaacttttccagaacattattgaaggtgtctactgtttataaaaaacccatatttttactcctcttagatttaatactttcacttttctgtttttcaatgcaagttcattttctgcagccgtaacaggatgcccagcttgctggcgctgcagcagccagcagaaacgatcaagcccatggagcacagagaaaacgctttggaaataaaagtagtgcatataatacttgcagagaagcagccgtagaataactgatggcattagatgaagcacccgatattcttatacggatcaggtgaccgattacgagcaatctccaaaactaatcctacctggatgggacaaccagcgtttcactactctgcagaggccacaaaccacatccagtccaatgaaccaagaacatcttcagggatacaaaactaacagccagcctaatagcagaggcaagaaacaaattatagacctgatgtcgactggtctcagactctcggtcgttcgagaacccttttgctccatgtatccaggcacctcctctcatcagcaatttgctccatctctgcaggaaagaaaccttattagttggtgatattatttggtaccacttaaattttggtgacaggaatgtagttttctgacaaagtcaattactgaatataaaaaatatttgcacagctctgcatcaacagttgtccaagggatgcctcaaaaatctgtgcagattatcagtcgtcacgcagaagcagaacatcgtggtgtgctaggtctgcttcttgcactgggccatgaatccggtgggttgttaggtggtgtttaggaaggagggactaaactttagtcccttttacaaaagcaagtctttatgggagggactaaaatctctcctctcttagggcatcagcaatttatgctgacaaccacagccagagcccgggtcgagatgccaccacggccacaatccacgagcccggcgcgacaccaccgcgcgcgcgtgagccagccacaaacgcccgcggataggcgcgcgcacgccggccaatcctaccacatccccggcctccgcggctcgcgagcgccgctgccatccgatccgctgagttttggctatttatacgtaccgcgggagcctgtgtgcagagcagtgcatctcaagaagtactcgagcaaagaaggagagagcttggtgagctgcagag

SEQ ID NO: 16 - DNA, 353 bp, Oryza sativa
  misc_feature (1)...(353): Os12g17600 3'UTR
gccgtcatcgtcatatatagccttgtttaattgttcatctctgattcgatgatgtctcccaccttgtttcgtgtgttcccagtttgttcatcgtcttttgattttaccggccgtgctctgcttttgtttttgtttcacctgatctctctctgacttgatgtaagagtggtatctgctacgactatatgttgttgggtgaggcatatgtgaatgaaatatatggaagctccggctatatatatttatacaaagggtacgagatggatgtgaatcctagagcatatgtgtccaacaatcaattcgtcgacaatgaaaatttgatcatggaattaaaaaatcatgcttctgttgtt

SEQ ID NO: 17 - DNA, 1448 bp, Oryza sativa
  misc_feature (1)...(1448): Os02g1039 promoter
taaatattctcagtggctcatgttttagtcgctatatttctgctggccttgttcgataaatagacatatactccgtagaaggtgtttaactctcatgttctgaatgacaaatgttttgtccgcagcatttccgtaggctatgtttgccgtaatatggctgcattggaagttcttaattctaataccattttgtaggaggcatttcactcttggttattttccactacagtttcgatgtatttaactatcagttaaatcctcataaaagtacttcctccgtttcacaatgtaagtcattctagcattttccacattcatattgatgtatctagacatatgtatctatctaaactcattaacatcaatatgaatgtggaaaaggctagaatgacttacattgtgaaacggagggagtagcattttttggctcttcatttgtacatagcgcttagcttgaatgattgataccaaccctttttatctaccaggtaaatgatactgagtctgagagcgaggtagtacttgtttacagaagacccatttttatgtgaaggggacgcttctggaactgaccaaatttcacgcaagtcttggcagctatcggcattgtgcttccttcctttctgatagagaatcgaaatgggctactcgtagaatgaatgttagtttgttttcgtcagaatgtaaaactacatatgtgcagttcagtggtaaaaactctcaaaccgaacacgtgtaccgagattgtcttgtttttcaccctgtgaaattcgctctcatctctcactgttgtacttgatgcacaaaatgtacaaactgccaagatattgtgtttttcaatgaatagtagttttacactgtttacttcctacatgacctgatgaccaaccatgactccatgatatattgtttccttttttcttttctttttttggttttaagattgattaatatctcatgtcatatcattttgtcaatttttttggctgaataactggcactagttccatcacaaatgcaggatagaaacaacaccaatctgtgctatccacaaagcctaaacaaaaaaatctcagcaaatgccaacaatccaagaacacaccatgcacagatgcaggaaatgcaaacctcagctgcatgctgtgctggcagctggtaagccactgagaggcagctcccttatctcacctgcccccctgccacgtggcacactcctactgggtccactgatgccctcatctgctaagatgccacctcacaccagaattagatttccccgggcccaccccttttccatggccgacaacaagcacagcacccctgcaaccttgtgttcccctcatcccccttttctagcactcaccaagtttaatttggagcacacatttcagctcaccactgctagcttgggaagaggaggaggagcttgagcttggagagagacaaca

SEQ ID NO: 18 - DNA, 532 bp, Oryza sativa
  misc_feature (1)...(532): Os02g1039 3'UTR
agatgccatcaactacgtatttaattaattacgagtttttaattatgtatgtatgtacgtgcgtatgcgtatatgtgtgtacgtatgtatgtacgcaactttgtacgatcgatggtgcgtgtgatcgagaggggtatgtatgtacgtacgtatatacgatgtattattatgcatgggtgtagggtgtgggtgtaacatgtaaatttgtgctccaactgatttgcacgcatggtcgcatggatcgatttgctagcttgtctctcttttgttgggcatataactatttactacttttgttgattaaaagtttgtcactcaaagttccagtgataaatttttaattaacacttataaacgtggtaaatagttaaatatctcccttttattaggcggtagaactaggagtgtcccgtgtattttattttctccgtttttaaattattgtcatccacatgctacgctatgtaagatgtttcttagaagtatgtttatccctgacagtaaagaggaaaaaaatttttccggaagaaaa

SEQ ID NO: 19 - DNA, 1456 bp, Oryza sativa
  misc_feature (1)...(1456): Os04g56400 promoter
ttttggattatttaaattatgttaatctattattaccttccaaagttcctgctccgtacagactaattgcaacttcaaccggcagctcttctacttagtacttaaaatgtaatctattttcttttagttctcatcctagccacactttttacacaaactcgcctgctccttgattaaattagaaatatgttctttgtttcattatgaaatgtaacgttggatcgtagttatgtactgttccgctgttttgacttttgatacattactactacgatttcaaagagaaaatttggaaataaaagttactttaattatttcatagctgatgccatgccaacttgccaagcattagtatccttttttgtgaccagctggcagttaccatattcttggagagctttctgtatcaatctgtcttacgcaaccattttttaatttaattgtgtctacttgtccataaaacagtgcttctcatttagtttgagtaccaattcatgggatttggggggcattggaattgattacattgttcttatatttgttttatcaaatggttgtactctggaaactagccacaaaaaatgactgttttttcatcattgcttgtttgataaattactgctgtcaatgagagaccgtagtctacataaagcttaggggcaactgagaagtgagaactaaccaccaaattttatttgtttctcggagcattcttttggccacaatcaacacttaacaatgatactcttacaatatttccaagaagggaaccctttattgctggttggtttacagcataaattataccatgaaaagcctgttcttgtacatttattccatactcgtattactttagaacacaatgccatttttacctgtgatggtaaagaggactgctgatgttctgtggtattactggattactggaccattgtcagcgttggagcgttgtttgagtatgctgtttctcttataatctcttttgaaagaaaactgttattttatatttattttagtggcttaactcacaagaacagaacccttacaacagtagcatggtaatagcaactttgaatactcaaactggtagggctagggagcttgtggttcttgtcttctcccaagttgtgcatgcatagatgacaaaataacaagtcaacttttttggctactttgttgcagctgataatggtcttgtagaacttaatcaagtgctggagttatacagtatagccaatcagcgaacatttgctaactcttaccattgctttggagtcgaataaatataatatttttccgtagacaaaaagccaagatgctgctgttcccgcccgccactaaaaatatttatgcacctcctcgcattaaaaattccatcgacgtcgcctcctctcctcctcctcctcgtcgctgcattccggttgagtgagttggtgattatctgtagggggtgaaa

SEQ ID NO: 20 - DNA, 405 bp, Oryza sativa
  misc_feature (1)...(405): Os04g56400 3'UTR
agaacttggacgatgaatcggggcaaataaatcccagcaaaatttgtttgctgcccaccagtcttgatcttgtatttcttctgtctggggattggtctgtacaaatctgcagtttctagaaaaccacgccaccttccattcgccagttaacattttggttgaacaccacacttgatctgggtctgtattttgagtccatttgtgagtgacagaacggatgatgaaacacatcagggacacttttaagtttcttcagtcctgcgtccttccctcgaaataaaaatgtttccttgttttttatcccgggctaaacctgtagttgcgatgaaaacgtcactattggagacttggagaatataatttgacagttgacactcgaccatcatggactggtgttagttctca

SEQ ID NO: 21 - DNA, 1431 bp, Oryza sativa
  misc_feature (1)...(1431): Os01g40310 promoter
caccgtttagcagtttgaaaagcgtgcgcgcggaaaacgagggagaggggttggtaacttggagttccaaacacagcctaacaatatctactgaggaaggaacttaagataaaaatggagtttaataattgcaatctatataaaaataatgtgatgatggagagatcaaaccttgtaagaagctttgacttactcccatcccagtgaagaatacaatatctgtatctttccgtacaaatgaaaagagaatcttaattcttgaggttcattcaaggaatgaagagcgttatcttttcgcttatgcttatgcttttcaactaaaatttgaatttttaacttcaaatttggagttgattttggggttttttcattgaaatttatttttcagcttttgcttttaaattgctaaaaacacgtatataaaagttttattcacaaattatttttcgtttgcaaatatgccataacgatgggaccggaaaacataagatcttaagatcagtcctacaacaatactgtctgaaggcagggagaatctttcaattttttagctgtagaaacagagtacaaacttacacatggacggaagagctcaattgttgcaattctaccatacacaggtgcatcaagcataggctggtaaggaaagaaaaggtcttacagagttatagttgtaagaatatcatgtaaccagttgatctgccaggacaaattctaacttgtcaactaaaagtatatcagcatttatctgaacaacagtagccattatgaataaccttaaaaaacaccttttcaacaattgatgctaacaacaaggcacagttatttgctgtccataataatagataggttcaaacagaaggaacatattctggtcgaggcaaatctgtctgacctgaagaccctgatgagtaagcagatactccaatctcaatacgggtaaatttcctgaaagttgttgtacggtcaagctttagcccaaacaaatgaaggatgtacataaaattttggagaaaaatagaagtcaaatacacacaaaaaaaacatattagaaaaaacacaatcaatctaagttttattaactcacagatgttttactgcttcaccatcatcacagtaccacgaattttttttaaaataaatgagtaggctaacatccactacaactgaatccacaagcccatttctgatgaatgactagtgtgaatgactagtgtgctacacgaactgagaattccaaacaacaatacatggagaaggaaaaatagaacaaatacacgggggagctcttaaatttcccagacaaagctgctctccattggccacactccgattcctctcttccttcctaaaaaaaaaagaaacaaaaagaagcgtcgaattcttgcttcgccagaggaagaagagaagagagaaggggaggaggaagaa

SEQ ID NO: 22 - DNA, 195 bp, Oryza sativa
  misc_feature (1)...(195): Os01g40310 3'UTR
tcgtcgccgcagggtttgatgatcactaggacatgtacgtattaatcaccgtatttatacagtgcttagtgtgttactagtatcgactggttctcgagatgaaaatttgttgtaaatttcaaggagtttcaggctgcaatggatgattgtgtaattaggaacgggaaaaaaagggggctcctaggctcctagcaa

SEQ ID NO: 23 - DNA, 1197 bp, Zea mays
  misc_feature (1)...(1197): Fructose 1,6-bisphosphatase
atgccgttgtcgtctttctccttcctccgccaccacctgccgctccctcttcagctcccgccaacttcaaatcgtcagccaccacacccccgcctcttccacctcctcctccctccgttcacaccgcgccgcaccttcgtctgccagccgctcaccgcggccacggacgatatggctgctgcggccgcggcggcgtcgccccccacactgctcgagcacatgggccaggcgggcacggccgctgacctcactgtccttgtggcccatatccagagcgcgtgcaagcgcatcgcggctctcgtggcgtcccccggcaacgccgagctgtcgcgggccaaggcgaggggtggggctatggcggcagggcgtgacgcgcctaagccgctcgacgaattgtcgaatgatatcatcttgtcagcgctccaaagttctggaaaggttgcagcgctagcatctgaagaaaacgatctgcccatttggatatctgatggcggtccatatgttgttgttactgatccgcttgatggttctcgcaacattgaggtctccatacctaccggaacaatatttgggatctacaataggctggtggaggtcgaccatctccctttggaggagagagctcagctcaactcactgcaaagtggaactcgccttgttgctgctggatatgtcctgtactcatctgccaccatcttgtgtatcagctttggtgcaggtacccatgccttcacattggattggtcgactggagaattcatccttacacatccttccatccaaataccacctagagggcagatatattcagtgaacgacgctaggtattttgactggcccgagggcttaaggaagtacattgacacaatcagacaaggcaaaggacagcatccgaagaagtactcagctcgctacgtgtgctcactggtggctgatttccaccggacgctcatatatggcggggtcgctatgaacccaagggaccatctgcggctggtttatgaggcgaaccctctcagtttccttgctgaacaggctgggggtagagggtcagatggcaagaacagaatcctcaccattcagcctgtgaagttgcaccagaggctgcctttgttcttaggaagcatggatgacatgcttgagttggaaagctacggagatgtgcagcagaaggtcaatcctggatatgaagtttaa

SEQ ID NO: 24 - protein, 398 aa, Zea mays
  DOMAIN (1)...(398): Fructose 1,6-bisphosphatase
MPLSSFSFLRHHLPLPLQLPPTSNRQPPHPRLFHLLLPPFTPRRTFVCQPLTAATDDMAAAAAAASPPTLLEHMGQAGTAADLTVLVAHIQSACKRIAALVASPGNAELSRAKARGGAMAAGRDAPKPLDELSNDIILSALQSSGKVAALASEENDLPIWISDGGPYVVVTDPLDGSRNIEVSIPTGTIFGIYNRLVEVDHLPLEERAQLNSLQSGTRLVAAGYVLYSSATILCISFGAGTHAFTLDWSTGEFILTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILTIQPVKLHQRLPLFLGSMDDMLELESYGDVQQKVNPGYEV

SEQ ID NO: 25 - DNA, 1167 bp, Zea mays
  misc_feature (1)...(1167): FBP aldolase
atggcttctgctacagtgctcaagtcttctttcctccctaagaagtctgagtggggcgctacaaggcaggctgctgctcctaggcctcctacagtgtctatggtggtgagggcttctgcttacgctgatgagctcgtgaagacagctaagacaattgcttctcctggcaggggcattctcgctatggatgagtctaatgctacatgcggcaagaggctcgcttctattggcctcgagaatacagaggctaataggcaggcttacaggacactcctcgtgacagctcctggcctcggccagtacatttctggcgctattctcttcgaggagacactctaccagtctgctgtggatggcaggaagattgtggatattctcgtggagcagggcattgtgcctggcattaaggtggataagggcctcgtgcctctcgctggctctaataatgagtcttggtgccagggcctcgatggcctcgcttctagggaggctgcttactaccagcagggcgctaggttcgctaagtggaggacagtggtgtctattcctaatggcccttctgagctcgctgtgaaggaggctgcttggggcctcgctaggtacgctgctatttctcaggataatggcctcgtgcctattgtggagcctgagattctcctcgatggcgagcatggcattgagaggacattcgaggtggctcagaaggtgtgggctgagacattctacgctatggctgagaataatgtgatgttcgagggcattctcctcaagccttctatggtgacacctggcgctgaggctaaggatagggctacacctgagcaggtggctgcttacacactcaagctcctccataggaggattcctccttctgtgcctggcattatgttcctctctggcggccagtctgaggtggaggctacacagaatctcaatgctatgaatcagggccctaatccttggcatgtgtctttctcttacgctagggctctccagaatacatgcctcaagacatggggcggccagcctgataaggtgaaggctgctcaggatgctctcctcctcagggctaaggctaattctctcgctcagctcggcaagtacacatctgatggcgaggctgctgaggctaaggagggcatgttcgtgaagaattactcttactga

SEQ ID NO: 26 - protein, 388 aa, Zea mays
  DOMAIN (1)...(388): FBP aldolase
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 27 - DNA, 1887 bp, Zea mays
  misc_feature (1)...(1887): Transketolase
atgggccacgtcctctacgacgaggtcatgcgctacaaccccaagaacccctactggttcaaccgcgaccgcttcgtcctctccgccggccacggctgcatgctccagtacgccctcctccacctcgccggatacgacagcgttaaggaggaggacttgaagcagttcaggcaatggggaagcagaacaccgggccaccctgagaactttgagactccaggagttgaagttaccaccgggcctcttggtcagggtatcgccaatgccgttgggttggcacttgctgagaagcacctggctgcccgcttcaacaagcctgacagtgagatcgtcgaccactacacgtacgttattttgggagatggctgccaaatggagggtattgctaatgaagcttgctccttggctggacactggggtcttggcaagctgattgctttctacgatgacaaccacatttccatcgacggagacacggagattgcattcacagaggacgtgagcacccgcttcgaggctcttgggtggcacacgatctgggttaagaatgggaacaccggatatgatgacatccgcgcagccattaaggaggcgaaggcagttactgacaagcccaccttgatcaaggtgactaccacgatcggttttggatctcccaacaaggccaactcatacagtgttcatggaagtgcactgggtgccaaagaggttgaagcaaccaggcagaaccttggatggccctatgacacattctttgtaccagaggacgtcaagagtcactggagccgccacacacccgaaggtgctgcacttgaggctgattggaacgctaagtttgcagagtacgagaagaagtatgcagatgatgcagcaaccttgaaaagtatcatcacgggggagttacccactggctgggttgatgctcttcctaaatacactccagagagcccaggagatgccaccaggaacctctcccagcagtgcctgaacgcccttgctaatgttgtgcctggtcttatcggaggcagtgctgatcttgcatcctccaacatgactctgctgaagatgtttggtgacttccagaaggatacagctgaagagcgcaatgtccgcttcggagtcagagagcacggaatgggcgccatttgcaacggcattgctctgcacagcccagggtttgttccgtactgtgctacattctttgtcttcactgattacatgagaggtgccatgaggatctcggccctgtctgaagccggagtcatctatgtcatgacccacgactctattggtctcggagaagatggcccgacccatcagcccatcgagcacctggtgagcttccgtgcgatgccgaacatactgatgctccgccctgctgatggcaacgagactgccggagcatacaaagtcgcggtcctcaacaggaagaggccgtccatcctcgctctctccaggcaaaagctccctcacctgcctggcacctcgatcgagggcgtggagaagggcgggtacaccatctctgacaactcgaccggcaacaagcctgacatcattgtgatgggcaccggctccgagctggagatcgcggccaaggccgccgacgagctgaggaaggaggggaagacggtccgcgtcgtctcgttcgtctcctgggaactctttgatgagcagtcggatgagtacaaggagagcgtcctccctgccgccgtcacagcgaggatcagcatcgaggccgggtccactctcggctggcagaagtacgtcggagcccagggcaaggccattggcatcgacaagttcggcgcgagtgctcctgccgggacgatctacaaggagtacggcatcaccgtggagagcatcattgcagctgccaagagcttttaa

SEQ ID NO: 28 - protein, 628 aa, Zea mays
  DOMAIN (1)...(628): Transketolase
MGHVLYDEVMRYNPKNPYWFNRDRFVLSAGHGCMLQYALLHLAGYDSVKEEDLKQFRQWGSRTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNTGYDDIRAAIKEAKAVTDKPTLIKVTTTIGFGSPNKANSYSVHGSALGAKEVEATRQNLGWPYDTFFVPEDVKSHWSRHTPEGAALEADWNAKFAEYEKKYADDAATLKSIITGELPTGWVDALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDIIVMGTGSELEIAAKAADELRKEGKTVRVVSFVSWELFDEQSDEYKESVLPAAVTARISIEAGSTLGWQKYVGAQGKAIGIDKFGASAPAGTIYKEYGITVESIIAAAKSF

SEQ ID NO: 29 - DNA, 513 bp, Zea mays
  misc_feature (1)...(513): Rubisco small subunit
atggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcaccgacgccacgcaggtgtacaaggagctgcaggaggccatcgccgcgtacccggacgccttccaccgcgtcatcggcttcgacaacgtcaggcagacgcagtgcgtcagcttcatcgcctacaagccccccggcagcgagtag

SEQ ID NO: 30 - protein, 170 aa, Zea mays
  DOMAIN (1)...(170): Rubisco small subunit
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 31 - DNA, 1431 bp, Zea mays
  misc_feature (1)...(1431): Rubisco large subunit
atgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgtttcgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatataa

SEQ ID NO: 32 - protein, 476 aa, Zea mays
  DOMAIN (1)...(476): Rubisco large subunit
MSPQTETKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYSKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFARELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDGFKAMDTI

SEQ ID NO: 33 - DNA, 1152 bp, Zea mays
  misc_feature (1)...(1152): Rubisco activase
atggctgccaaggaggtggacgagacgaagcagaccgacgaggacaggtggaagggcctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaacttcgacaacatgatggatggcttctacatagccaagggcttcatggacaagctcgtcgtccacctctccaagaacttcatgaccctgccaaacatcaaggttcccctcatcctgggtatctggggaggcaaaggccagggaaaatcgttccaatgcgagctggtcttcgccaagatgggcatcacccccatcatgatgagcgccggcgagctggagagcggcaacgccggagagcccgccaagctcatcaggcagcgctaccgtgaggcctccgacctcatcaagaagggcaagatgtcctgcctcttcatcaacgacctcgacgccggcgcgggtcgcatgggcggcaccacccagtacacggtgaacaaccagatggtcaacgccaccctgatgaacatcgccgacaaccccaccaacgtgcagctcccggggatgtacaacaaggaggacaacccccgcgtgcccatcatcgtcaccggcaacgacttctccacgctctacgcgccgctcatccgcgacggccgcatggagaagttctactgggcgcccacccgcgaggaccgcatcggcgtctgcaagggcatcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgctggtggcggagcaggagaacgtcaagcgtgtgcagcttgctgacaagtacctcaacgaggctgctcttggtgaagccaacgaggacgccatgaagactggctccttcttcaagtag

SEQ ID NO: 34 - protein, 383 aa, Zea mays
  DOMAIN (1)...(383): Rubisco activase
MAAKEVDETKQTDEDRWKGLAYDISDDQQDITRGKGLVDNLFQAPMGDGTHVAVLSSYDYISQGQKSYNFDNMMDGFYIAKGFMDKLVVHLSKNFMTLPNIKVPLILGIWGGKGQGKSFQCELVFAKMGITPIMMSAGELESGNAGEPAKLIRQRYREASDLIKKGKMSCLFINDLDAGAGRMGGTTQYTVNNQMVNATLMNIADNPTNVQLPGMYNKEDNPRVPIIVTGNDFSTLYAPLIRDGRMEKFYWAPTREDRIGVCKGIFRTDGVDEEHVVQLVDTFPGQSIDFFGALRARVYDDEVRRWVSETGVENIARKLVNSKEGPPTFEQPKITIEKLLEYGHMLVAEQENVKRVQLADKYLNEAALGEANEDAMKTGSFFK

SEQ ID NO: 35 - DNA, 1518 bp, Zea mays
  misc_feature (1)...(1518): ADP-glucose pyrophosphorylase, large subunit
atgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcggaggaccaggcgctggaggctaggaactccaagacggtggtggcggtcatcctcggcggtggcgccgggaccaggctcttcccgcttaccagacgcagggccaagcccgcggtgccaattggcggcgcgtacaggctcatcgacgtgccgatgagcaactgcataaacagcgggatcaacaaggtctacatcctcacgcagttcaactcgcaatccctcaatcgccacctctccagagcctacgatttcagcaatggcgtggccatcggagacggattcgtcgaggttctagcagcaacccagaggcctggaacggaggggaaaaggtggtttcagggtactgctgatgcagttcggcagttcgactggcttttcgatgatgcaaaatctaaagacattgaagatgtgctgattctttctggtgaccatctctaccgtatggactacatggactttgttcagagtcatcggcaaagaggtgcaggcatcagcatctgttgtttgccaattgatggcagccgggcatctgattttggcctaatgaagatagacgacactggaagggtaatttcattcagtgagaaaccaaaaggagacgaattaaaggcaatgcaagttgacaccacagtgcttggcttatcaaaggaggaagcagaaaacaaaccttatatagcttcaatggggatctatatttttaagaaagacatactcctaaaccttctaagatggcgttttcccactgcaaatgattttggttctgaaataattcctgcttcagcaaaagaaatcgatgtaaaggcttatcttttcaatgattactgggaagatattggaactattaagtccttctttgaggcaaaccttgctcttgctgaacagcctccaaggttcagtttctacgatgctgacaaaccaatgtatacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgccgtggaaagaggagagctgcttgcagaaggaaaagttcctattgggattggagagaatacaacgattcaaaagtgtatcatagacaagaatgcgaggatagggaagaaagtggtaatctccaactctgaaggtgtagatgaagctgatagaacttccgaaggcttctacattcgatctggcatcactgtcgtactgaagaacgcgataattgctgatggattggtcatatga

SEQ ID NO: 36 - protein, 505 aa, Zea mays
  DOMAIN (1)...(505): ADP-glucose pyrophosphorylase, large subunit
MGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 37 - DNA, 1554 bp, Zea mays
  misc_feature (1)...(1554): ADP-glucose pyrophosphorylase, small subunit
atggcgatggcagccatagcctccccgtcgtcgaggaccctgatccctccgcgacaccacggcgccgcgccctccccgtccacctccggcgactcctcgctccgcctcctctgcgcacacccgcgccacggacggcgcggccgggcgatgtccgtctcgacgcccgcggcgcggagccggccgttcgtcttctccccgcgcgcggtgtccgactctaagagctcccagacctgcctcgaccccgacgccagcacgagtgttcttggaatcattctcggaggtggtgctgggactagattgtaccccttgacaaagaagcgtgccaagcctgcagtgccattgggtgccaactatagactgattgatatccccgtcagcaattgtctcaacagcaacatatccaagatctatgtgctaacacaattcaactctgcttccctcaaccgtcacctctcaagagcctacgggaacaacattggagggtacaagaatgacgggttcgttgaagtcttagctgcacagcagagcccagataatccaaactggtttcagggtactgcagatgctgtaaggcaatacttgtggttatttgaggaacataatgtgatggagtttctaattcttgctggcgatcacctgtaccggatggattatgaaaagttcattcaggcacacagagaaacggatgctgatattactgttgctgccctaccaatggatgagaaacgtgcaaccgcatttggcctcatgaaaattgacgaagaagggaggattattgagtttgctgagaaaccgaaaggagatcagttgaaagcaatgatggttgacaccaccatacttggccttgatgacgagagggcaaaggaaatgccttatattgctagcatgggtatatatgtttttagcaaggatgtaatgcttcagctcctccgtgaacaatttcctggagccaatgattttggaagtgaggttattccaggtgcaacaagcattggaaagagggttcaggcttatctatatgatggttattgggaagatattggtacaattgaggcattttataatgcaaacttgggaataaccaagaagccaataccagatttcagcttctatgaccgttctgctccaatctatacacaacctcgacatctgccaccttcaaaggttcttgatgctgatgtgacagacagtgttattggtgagggatgtgttattaaaaactgcaagatacaccattctgtagttggactccgttcttgcatatctgaaggtgctatcatagaggacactttactaatgggtgcggactactatgagactgaagctgacaagaaactccttgccgaaaatggtggcattcccattggtattgggaagaattcacacatcagaaaagcaatcattgacaagaatgctcgaattggagataatgtgaagatactcaacgctgacaatgttcaagaagctgcaagggagacagacgggtacttcatcaaaggtggaattgtcacagtgatcaaggatgctttactccctagtgggacagttatatga

SEQ ID NO: 38 - protein, 517 aa, Zea mays
  DOMAIN (1)...(517): ADP-glucose pyrophosphorylase, small subunit
MAMAAIASPSSRTLIPPRHHGAAPSPSTSGDSSLRLLCAHPRHGRRGRAMSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRKAIIDKNARIGDNVKILNADNVQEAARETDGYFIKGGIVTVIKDALLPSGTVI

SEQ ID NO: 39 - DNA, 1638 bp, Zea mays
  misc_feature (1)...(1638): Carbonic Anhydrase
atgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtctgtaaacgggacggcgggcagctgaggagtcaaacgagagagatcgagagagaaagaaagggagggcatccaccagccggcgggcataagaggggaggagagagaggccagagaagaggaggagaagaagaagaagatgagcagctgcctctgccttccgaaaaaaaaggaggggccagcgaaggagaagccgtccacagatacccccacctcgtcactccttcagaaccagaagccctccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggactgcagcccggcgaggcattcaccgtccgcaacatcgcttccatggtcccaccctacgacaagatcaagtacgccggcacagggtccgccatcgagtacgccgtgtgcgcgctcaaggtgcaggtcatcgtggtcattggccacagctgctgcggtggcatcagggcgctcctctccctcaaggacggcgcgcccgacaacttcaccttcgtggaggactgggtcaggatcggcagccctgccaagaacaaggtgaagaaagagcacgcgtccgtgccgttcgatgaccagtgctccatcctggagaaggaggccgtgaacgtgtcgctccagaacctcaagagctaccccttcgtcaaggaagggctggccggcgggacgctcaagctggttggcgcccactcacacttcgtcaaagggcagttcgtcacatgggagcctccccaggacgccatcgagcgcttgacgagcggcttccagcagttcaaggtcaatgtctatgacaagaagccggagcttttcgggcctctcaagtccggccaggcccccaagtacatggtgttcgcctgctccgactcccgtgtgtgcccgtcggtgaccctgggcctgcagccgggcgaggccttcaccgttcgcaacatcgccgccatggtcccaggctacgacaagaccaagtacaccggcatcgggtccgccatcgagtacgctgtgtgcgccctcaaggtggaggtcctcgtggtcattggccatagctgctgcggtggcatcagggcgctcctctcactccaggacggcgcagcctacaccttccacttcgtcgaggactgggttaagatcggcttcattgccaagatgaaggtaaagaaagagcacgcctcggtgccgttcgatgaccagtgctccattctcgagaaggaggccgtgaacgtgtccctggagaacctcaagacctaccccttcgtcaaggaagggcttgcaaatgggaccctcaagctgatcggcgcccactacgactttgtctcaggagagttcctcacatggaaaaagtga

SEQ ID NO: 40 - protein, 545 aa, Zea mays
  DOMAIN (1)...(545): Carbonic Anhydrase
MYTLPVRATTSSIVASLATPAPSSSSGSGRPRLRLIRNAPVFAAPATVCKRDGGQLRSQTREIERERKGGHPPAGGHKRGGERGQRRGGEEEEDEQLPLPSEKKGGASEGEAVHRYPHLVTPSEPEALQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFTFVEDWVRIGSPAKNKVKKEHASVPFDDQCSILEKEAVNVSLQNLKSYPFVKEGLAGGTLKLVGAHSHFVKGQFVTWEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSLQDGAAYTFHFVEDWVKIGFIAKMKVKKEHASVPFDDQCSILEKEAVNVSLENLKTYPFVKEGLANGTLKLIGAHYDFVSGEFLTWKK

SEQ ID NO: 41 - DNA, 2913 bp, Zea mays
  misc_feature (1)...(2913): PEP Carboxylase
atggcgtcgaccaaggcacccggccccggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtctcggccgactacgagggcaaaggagacacgacgaagctgggcgagctcggcgccaagctcacggggctggcccccgccgacgccatcctcgtggcgagctccatcctgcacatgctcaacctcgccaacctggccgaggaggtgcagatcgcgcaccgccgccgcaacagcaagctcaagaaaggtgggttcgccgacgagggctccgccaccaccgagtccgacatcgaggagacgctcaagcgcctcgtgtccgaggtcggcaagtcccccgaggaggtgttcgaggcgctcaagaaccagaccgtcgacctcgtcttcaccgcgcatcccacgcagtccgcccgccgctcgctcctgcagaaaaacgccaggatccggaattgtctgacccagctgaatgccaaggacatcactgacgacgacaagcaggagctcgatgaggctctgcagagagagatccaagcagccttcagaaccgatgaaatcaggagggcacaacccaccccccaggacgaaatgcgctatgggatgagctacatccatgagactgtatggaagggcgtgcctaagttcttgcgccgtgtggatacagccctgaagaatatcggcatcaatgagcgccttccctacaatgtttctctcattcggttctcttcttggatgggtggtgaccgcgatggaaatccaagagttaccccggaggtgacaagagatgtatgcttgctggccagaatgatggctgcaaacttgtacatcgatcagattgaagagctgatgtttgagctctctatgtggcgctgcaacgatgagcttcgtgttcgtgccgaagagctccacagttcgtctggttccaaagttaccaagtattacatagaactctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggttttcacgttcgggctctccctggtgaagctggacatccggcaggagtcggagcggcacaccgacgtgatcgacgccatcaccacgcacctcggcatcgggtcgtaccgcgagtggtccgaggacaagcggcaggagtggctgctgtcggagctgcgaggcaagcgcccgctgctgcccccggaccttccccagaccgaggagatcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtgcgccagccgctgcccgtggtgccgctgttcgaaaggctggcctacctgcagtcggcgcccgcgtccgtggagcgcctcttctcggtggactggtacatggaccggatcaagggcaagcagcaggtcatggtcggctactccgactccggcaaggacgccggccgcctgtccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggaggcgcgcttcgtcgagtacttcagatcggctacaccggagaccgagtacgggaggatgaacatcggcagccggccagccaagaggaggcccggcggcggcatcacgaccctgcgcgccatcccctggatcttctcgtggacccagaccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctag

SEQ ID NO: 42 - protein, 970 aa, Zea mays
  DOMAIN (1)...(970): PEP Carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNSKLKKGGFADEGSATTESDIEETLKRLVSEVGKSPEEVFEALKNQTVDLVFTAHPTQSARRSLLQKNARIRNCLTQLNAKDITDDDKQELDEALQREIQAAFRTDEIRRAQPTPQDEMRYGMSYIHETVWKGVPKFLRRVDTALKNIGINERLPYNVSLIRFSSWMGGDRDGNPRVTPEVTRDVCLLARMMAANLYIDQIEELMFELSMWRCNDELRVRAEELHSSSGSKVTKYYIELWKQIPPNEPYRVILGHVRDKLYNTRERARHLLASGVSEISAESSFTSIEEFLEPLELCYKSLCDCGDKAIADGSLLDLLRQVFTFGLSLVKLDIRQESERHTDVIDAITTHLGIGSYREWSEDKRQEWLLSELRGKRPLLPPDLPQTEEIADVIGAFHVLAELPPDSFGPYIISMATAPSDVLAVELLQRECGVRQPLPVVPLFERLAYLQSAPASVERLFSVDWYMDRIKGKQQVMVGYSDSGKDAGRLSAAWQLYRAQEEMAQVAKRYGVKLTLFHGRGGTVGRGGGPTHLAILSQPPDTINGSIRVTVQGEVIEFCFGEEHLCFQTLQRFTAATLEHGMHPPVSPKPEWRKLMDEMAVVATEEYRSVVVKEARFVEYFRSATPETEYGRMNIGSRPAKRRPGGGITTLRAIPWIFSWTQTRFHLPVWLGVGAAFKFAIDKDVRNFQVLKEMYNEWPFFRVTLDLLEMVFAKGDPGIAGLYDELLVAEELKPFGKQLRDKYVETQQLLLQIAGHKDILEGDPFLKQGLVLRNPYITTLNVFQAYTLKRIRDPNFKVTPQPPLSKEFADENKPAGLVKLNPASEYPPGLEDTLILTMKGIAAGMQNTG

SEQ ID NO: 43 - DNA, 2916 bp, Zea mays
  misc_feature (1)...(2916): Pyruvate phosphate dikinase
atgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggagatggcgagcatcgggctgtcggtgccgccggggttcacggtgtcgacggaggcgtgccagcagtaccaggacgccgggtgcgccctccccgcggggctctgggccgagatcgtcgacggcctgcagtgggtggaggagtacatgggcgccaccctgggcgatccgcagcgcccgctcctgctctccgtccgctccggcgccgccgtgtccatgcccggcatgatggacacggtgctcaacctggggctcaacgacgaagtggccgccgggctggctgccaagagcggggagcgcttcgcgtacgactccttccgacgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcactaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgcagctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgtgtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctcacgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctga

SEQ ID NO: 44 - protein, 971 aa, Zea mays
  DOMAIN (1)...(971): Pyruvate phosphate dikinase
MIVQPIELRAWTAFPGSAQEGIGRMAASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMACVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 45 - DNA, 999 bp, Zea mays
  misc_feature (1)...(999): Malate dehydrogenase
atggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgtttcaatctacaaatcccaagcatctgcccttgaagcccatgcagctcccaactgcaaggttctggtggttgccaacccagcaaacaccaatgctcttatcttgaaagaatttgctccatctattccagagaagaacgttacttgcctgacccgtctggaccacaacagggctcttggccagatttctgagagacttaatgtccaagttagtgatgtgaagaatgttatcatctggggtaaccactcgtcctctcagtaccctgatgttaaccatgccacagtgaagacttccactggggagaagcctgttcgtgagcttgtctctgatgacgagtggcttaatggtgaattcatcacaactgtccaacagcgtggtgctgcaatcattaaagcgagaaagttctccagtgctctctcggctgctagctctgcttgtgaccacattcgtgattgggttcttggaacacctgagggtacatttgtttccatgggtgtgtactctgatggttcatacggtgttccttctggactcatttattcattcccagtaacatgcagtggtggtgaatggaaaatcgttcaaggcctcccgattgatgagttctcaaggaagaagatggatgccactgcccaagagctgacggaggagaagacgcttgcttactcatgcctcgagtaa

SEQ ID NO: 46 - protein, 332 aa, Zea mays
  DOMAIN (1)...(332): Malate dehydrogenase
MAKEPMRVLVTGAAGQIGYALVPMIARGVMLGADQPVILHMLDIPPAAEALNGVKMELVDAAFPLLKGVVATTDVVEACTGVNVAVMVGGFPRKEGMERKDVMSKNVSIYKSQASALEAHAAPNCKVLVVANPANTNALILKEFAPSIPEKNVTCLTRLDHNRALGQISERLNVQVSDVKNVIIWGNHSSSQYPDVNHATVKTSTGEKPVRELVSDDEWLNGEFITTVQQRGAAIIKARKFSSALSAASSACDHIRDWVLGTPEGTFVSMGVYSDGSYGVPSGLIYSFPVTCSGGEWKIVQGLPIDEFSRKKMDATAQELTEEKTLAYSCLE

SEQ ID NO: 47 - DNA, 1911 bp, Zea mays
  misc_feature (1)...(1911): Malic enzyme
atgctgtccacgcgcaccgccgccgtcgccgcctccgcgtcccccgcctccccgtggaaggtgggaggacggagcgagggcggcgccagctgcgacggatgccggacctacaggaacaccctgcggaggagggccgcgcccgccaaggtgcgcgccttgccgcccaggcgggtggacgcggtcgccatggtctccaacgcggagacggagacggaaaaggagcaggaggaggcggcggccgccagcgaggagctgcccgtcatgccctgggccacctacgtcgcaagcggttacacccttttgagggatccacaccacaacaagggtcttgctttcacagaggaggaaagggatggacactacttgcgtggactgcttcctccggcagtactatttcaggaactccaaattaagaagttcatgaacaccctgcggcagtaccagacccctttgcagcggtatatagctatgatgaaccttcaggaaacggacgagaggcttttctacaagcttttaattgataatgtggtggagctgcttccttttgtttacacaccaactgtaggtgaggcctgccagaagtatgggtccatctttggacgaccacagggtctgtatgtcagcctgaaggacaaggggaaggtcctagaagttctaaggaactggccacataggaacattcaagttatctgtgttactgatggtgagcgaatcttgggacttggagacttgggttgtcagggaatgggaattcctgtaggcaaacttgctctatacactgctcttggaggagttgacccatcagtttgcttgcctatcacaattgatgttggtacaaataacgagaagctgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaaatatagcaagagccatcttgttttcaatgatgatatccagggcacagcatcagtggtcattgcaggtttgttagcagcactcaagatggttggtgggaccctggcagagcagacttatttgttccttggtgctggggaggctggaactggtattgcagaacttattgctcttgagatttcgaaacagacgaatgctccacttgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtctatcaaacctacagttctgattgggacatctggagttggaagaacattcacaaaagaaatcattgaggccatgtcttccttcaacgagaggcctatcatcttttcactgtcaaacccaacctcgcattctgaatgcactgctgaacaagcatatacatggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtag

SEQ ID NO: 48 - protein, 636 aa, Zea mays
  DOMAIN (1)...(636): Malic enzyme
MLSTRTAAVAASASPASPWKVGGRSEGGASCDGCRTYRNTLRRRAAPAKVRALPPRRVDAVAMVSNAETETEKEQEEAAAASEELPVMPWATYVASGYTLLRDPHHNKGLAFTEEERDGHYLRGLLPPAVLFQELQIKKFMNTLRQYQTPLQRYIAMMNLQETDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEKLLNDEFYIGLRQKRATGEEYDELIEEFMSAVKQFYGEKVLIQFEDFANHNAFDLLEKYSKSHLVFNDDIQGTASVVIAGLLAALKMVGGTLAEQTYLFLGAGEAGTGIAELIALEISKQTNAPLEECRKKVWLVDSKGLIVDSRKGSLQPFKKPWAHEHEPLKTLYDAVQSIKPTVLIGTSGVGRTFTKEIIEAMSSFNERPIIFSLSNPTSHSECTAEQAYTWSQGRSIFASGSPFAPVEYEGKTFVPGQSNNAYIFPGLGLGLVISGAVRVHEDMLLAASKALADQATQDNFEKGSIFPPFTSIRKISAHIAAAVAAKAYELGLATRLPPPSDLVKYAENCMYTPVYRNYR

SEQ ID NO: 49 - DNA, 1209 bp, Zea mays
  misc_feature (1)...(1209): Phosphoglycerate kinase
atggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctag

SEQ ID NO: 50 - protein, 402 aa, Zea mays
  DOMAIN (1)...(402): Phosphoglycerate kinase
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 51 - DNA, 1239 bp, Zea mays
  misc_feature (1)...(1239): Glyceraldehyde 3-phosphate dehydrogenase
atggcggcgctctccgtgcccctccacgccgccgccggatcccgcgccgccgcggccgaccccgtcaaggttccgtgcgtgaggagcactggttcagcccatttcggccgcgccttcccctccgtcgcggtctcctctttggctgcgaggcacatcgagccgatgagagcgatagctacacaggcgccccctgccgtgccacaatatttgagtggcgagaagacaaagatcggcatcaacggctttgggcggattggcaggttggtcctgcgaattgcaactagcagagacgatattgaagttgtggctgtgaatgaccctttcgttgatgctaagtacatggcctatatgttcaagtatgactctactcatggcccgtttaaaggttctatttgtgttgtggatgattcaaccctggagatcaatgggaagaaggtcacaattacaagcaaaagagatcctgcagagattccatggggtaactttggggctgaatatgttgttgaatcttctggtgtctttacaacgactgataaagcatcagcacacttaaagggtggtgctaagaaagtggtgatatctgcaccatcagcagatgctcccatgtttgtagttggagttaatgagaatagctatgattcgaagatgaatgttgtttctaatgcaagttgcaccaccaactgccttgctccacttgccaaggttgtacatgaggaatttggcatcgtggagggccttatgacaactgttcatgccacaacagccacccagaagaccgttgatggtccttcaatgaaggattggagaggaggacgtggtgctggccaaaacataattcctagctccactggtgcagcaaaggctgttggaaaagttctgcctgagctgaatggaaagctcactggcatggccttccgagttccaacaccaaatgtctctgttgtggacttgacatgccggattgagaaaaacgcctcctatgatgatgtgaaagcagccatcaaggcggcatcagagggtgcactcaaaggtattcttggctacacagacgaggacgttgtttccaatgattttgttggtgattctaggtcaagcatctttgatgccaaggctggtatcggactgagctcttctttcatgaagcttgtgtcttggtatgacaacgagtggggctacagcaaccgggttctggatctgatcgcccacatggctctcgtcagtgccgccgccaagctctga

SEQ ID NO: 52 - protein, 412 aa, Zea mays
  DOMAIN (1)...(412): Glyceraldehyde 3-phosphate dehydrogenase
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDSKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKNASYDDVKAAIKAASEGALKGILGYTDEDVVSNDFVGDSRSSIFDAKAGIGLSSSFMKLVSWYDNEWGYSNRVLDLIAHMALVSAAAKL

SEQ ID NO: 53 - DNA, 762 bp, Zea mays
  misc_feature (1)...(762): Triose phosphate isomerase
atgggccgcaagttcttcgtcggtggcaactggaaatgcaatggaaccacagatcaggtcgagaagattgtcaaaaccctgaatgaaggacaggttcccccttcagatgttgttgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaa

SEQ ID NO: 54 - protein, 253 aa, Zea mays
  DOMAIN (1)...(253): Triose phosphate isomerase
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 55 - DNA, 888 bp, Zea mays
  misc_feature (1)...(888): Ribulose 5-phosphate isomerase
atgcccaggccaagtgtagctccctcgttgcagttgcaggcccgtccgtgcccgaggtggccgcgccggaagcactgcccaccgtcctccgtggcaagccggagggttgcttgctcggcctcggcggccgacgccgacgtggtcgacctcttcgacgccgctaagctaactgtggacaagttcgtgacgagcggcatggtggtggggctcggctccggccctgcgtccgccctggccatccagtacctcggcacgcgcctccggcggggctctctcgcgggcatcaccgcagtgacctcgtccgtgctcagtgcgagcgaggcagacaaggcagggatacgggctaacagctaccaggaaggcacccagattgattttgctttcactgatgctgaagcgatcgaggagggcacgctggccgcagtcatcgggcggcggaagaccgagagcggagagccctctttcatggcggagaaggcgatggctaaatcagctcacaagcttgccttcatcactggaaacgacaagtacgtgacgacgggcgtcgagggttctattccggtcctgattaaaagtgggaactggatagacactgctgaagagatcgacgatttgtttctaggagacgcagaggtttggaggaggccgtcgtttggaactgctggtccacttgggggttaccacccactggttaccaaggatggccatcacgtgctcgatgttatcttcacaacaccaatccaagatcttggtcaggttgcagagaagttggacaaagttgatggcgttgtggatcacgggattatttgcagcaaccaaccatacgctgtcattgcatccaagggggaagtgcaggtcctggacgagaaatcttcggtgatacattag

SEQ ID NO: 56 - protein, 295 aa, Zea mays
  DOMAIN (1)...(295): Ribulose 5-phosphate isomerase
MPRPSVAPSLQLQARPCPRWPRRKHCPPSSVASRRVACSASAADADVVDLFDAAKLTVDKFVTSGMVVGLGSGPASALAIQYLGTRLRRGSLAGITAVTSSVLSASEADKAGIRANSYQEGTQIDFAFTDAEAIEEGTLAAVIGRRKTESGEPSFMAEKAMAKSAHKLAFITGNDKYVTTGVEGSIPVLIKSGNWIDTAEEIDDLFLGDAEVWRRPSFGTAGPLGGYHPLVTKDGHHVLDVIFTTPIQDLGQVAEKLDKVDGVVDHGIICSNQPYAVIASKGEVQVLDEKSSVIH

SEQ ID NO: 57 - DNA, 1146 bp, Zea mays
  misc_feature (1)...(1146): Phosphoribulokinase
atggcggccttcacggtgcacacgagcgccgccacctcgccctactcgccggcgggcacggccatccttctccgaagccggagtcgagcctaccccaccgccaccatccgcgtgtcgtgctcgaagacggtggtgatcggggtggcggcggactcagggtgcgggaagaccacgttcacgcggcgcctggcgagcgtgttgggcggcggggcggagccaccgagggccggccggaacccgggctccaacacgctcgtcagcgacaccaccacggtgatctgcctggacgactaccactcgctggacagggtcgggcggaaggcgaagggcgtcacggcgctggatccgaggttcgtcgacttcgacctcatgtacgagcaggtgagggccatcaaggagggccgcgccgtcgagaaacccgtctacaaccacgtcaccggcctcctcgacccgcccgagctcatcaccccgccgaacatcctcgtcatcaaggggctgcacccaatgttcgacgagcgcgtgagggacctgctagatttcagcatctacctggacatcagcaacgaggtgaagcttgcatggaaaatccagagagacatgggagagcgtggtgggcacagccttgagagcatcaaggcctccatcgaggcaaggaagcccgacttcgaagcttacattgagccgcagaagcagtacgcggacgccgtgatcgaggtcctgccgacgcagctgatcccgggcgacgacgagtgcaaggtggtgcgcgtgaagctgatcatgaaggaaggcgtggagcacttcgcccccgtgcacctcttcgacgaaggatccaccgtctactggatcccctgcggccggaagctctcctgctcctaccctggcatcaggttcgcctacggcttcgacacctacttcggacacgaggtgtcggtggtggagatggacgggcagttcgacaagctggacgagctcatctacgtggagacccacctgagcaacctgtcaaccaagttctacggggaggtgacgcagcagatgctcaggcacgccgacgtccccggcagcaacaacggcacggggctcttccagaccatcgtcgggctcaagatcagggacctctacgagcagatcgtcgcacgtcgctga

SEQ ID NO: 58 - protein, 381 aa, Zea mays
  DOMAIN (1)...(381): Phosphoribulokinase
MAAFTVHTSAATSPYSPAGTAILLRSRSRAYPTATIRVSCSKTVVIGVAADSGCGKTTFTRRLASVLGGGAEPPRAGRNPGSNTLVSDTTTVICLDDYHSLDRVGRKAKGVTALDPRFVDFDLMYEQVRAIKEGRAVEKPVYNHVTGLLDPPELITPPNILVIKGLHPMFDERVRDLLDFSIYLDISNEVKLAWKIQRDMGERGGHSLESIKASIEARKPDFEAYIEPQKQYADAVIEVLPTQLIPGDDECKVVRVKLIMKEGVEHFAPVHLFDEGSTVYWIPCGRKLSCSYPGIRFAYGFDTYFGHEVSVVEMDGQFDKLDELIYVETHLSNLSTKFYGEVTQQMLRHADVPGSNNGTGLFQTIVGLKIRDLYEQIVARR

SEQ ID NO: 59 - DNA, 825 bp, Zea mays
  misc_feature (1)...(825): Ribulose 5-phosphate 3-epimerase
atggcgacaccgtcgtcgtcgctttgctccagcttcgcctccctgcggaccgcctccatcggccacccccgcggcatcgcgtcatctacgcccaggaaggcgttccaagtgagggcatcagctcgggttgacaagttctcaaagagtgatatcattgtgtccccttcgattctgtctgcaaacttcgccaagcttggtgatcaggtaaaagccgtggaggtggcaggatgtgactggattcatgtcgatgtcatggacgggcgctttgtgccaaatatcacaattggacctttggttgttgatgctctgcgtcctgtgactgatcttccattggatgtacatctgatgattgtggaacctgagcagcgagtccctgattttatcaaggcaggtgctgatattgttagtgtccactgtgaacaaacatcgaccatccatttgcacagaacagtcaatcagattaaaagtctaggagcaaaggcaggagttgttttgaatccagcgactccactcaatgcaattgattacattcttgatgttgttgacctggtgttgattatgtctgtgaatcctgggtttggtggccagagctttatcgagagtcaagtaaggaaaattgcagaattgagaaggttatgtgcagagaagggagtgaacccctggattgaggttgatggtggtgttggtccgaaaaatgcctacaaggttattgaagctggggcgaatgccatcgttgctggctctgcagttttcggggctccagactacgctgaagctatcaaaggaatcaagaccagccaaaggcctgcagctgtacacgcataa

SEQ ID NO: 60 - protein, 274 aa, Zea mays
  DOMAIN (1)...(274): Ribulose 5-phosphate 3-epimerase
MATPSSSLCSSFASLRTASIGHPRGIASSTPRKAFQVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLNAIDYILDVVDLVLIMSVNPGFGGQSFIESQVRKIAELRRLCAEKGVNPWIEVDGGVGPKNAYKVIEAGANAIVAGSAVFGAPDYAEAIKGIKTSQRPAAVHA

SEQ ID NO: 61 - DNA, 20 bp, Artificial Sequence
  Synthetic primer for B. distachyon ubc18 amplification
ggaggcacctcaggtcattt

SEQ ID NO: 62 - DNA, 20 bp, Artificial Sequence
  Synthetic primer for B. distachyon ubc18 amplification
atagcggtcattgtcttgcg

SEQ ID NO: 63 - DNA, 19 bp, Artificial Sequence
  Synthetic primer for B. distachyon native SBPase amplification
agactctctacggctcgtc

SEQ ID NO: 64 - DNA, 24 bp, Artificial Sequence
  Synthetic primer for B. distachyon native SBPase amplification
cttcttgtttactcagttcgtttc

SEQ ID NO: 65 - DNA, 22 bp, Artificial Sequence
  Synthetic primer for SBPase transgene amplification from 130006 construct
ctccaagaacgagatcatcagg

SEQ ID NO: 66 - DNA, 19 bp, Artificial Sequence
  Synthetic primer for SBPase transgene amplification from 130006 construct
acatcggcagcttaaacga

SEQ ID NO: 67 - DNA, 17 bp, Artificial Sequence
  Synthetic primer for SBPase transgene amplification from 130007 construct
accctctacggctcctc

SEQ ID NO: 68 - DNA, 17 bp, Artificial Sequence
  Synthetic primer for SBPase transgene amplification from 130007 construct
ggcgctggtgttgtaga

SEQ ID NO: 69 - DNA, 20 bp, Artificial Sequence
  Synthetic primer for SBPase transgene amplification from 130008 construct
ggctccaagaacgagatcat

SEQ ID NO: 70 - DNA, 20 bp, Artificial Sequence
  Synthetic primer for SBPase transgene amplification from 130008 construct
cagcttaacacggacacaca

SEQ ID NO: 71 - DNA, 20 bp, Artificial Sequence
  Synthetic primer for SBPase transgene amplification from 130009 construct
ggctccaagaacgagatcat

SEQ ID NO: 72 - DNA, 25 bp, Artificial Sequence
  Synthetic primer for SBPase transgene amplification from 130009 construct
cgatatcctcaggtagtacttatgc

SEQ ID NO: 73 - DNA, 21 bp, Artificial Sequence
  Synthetic primer for SBPase transgene amplification from 130011 construct
agatcatcaggttcgaggaga

SEQ ID NO: 74 - DNA, 21 bp, Artificial Sequence
  Synthetic primer for SBPase transgene amplification from 130011 construct
gcatcgatcccgtttgaattg

SEQ ID NO: 75 - DNA, 20 bp, Artificial Sequence
  Synthetic primer for SBPase transgene amplification from 130014 construct
ggctccaagaacgagatcat

SEQ ID NO: 76 - DNA, 22 bp, Artificial Sequence
  Synthetic primer for SBPase transgene amplification from 130014 construct
tgtcctagtgatcatcaaaccc

SEQ ID NO: 77 - DNA, 25 bp, Artificial Sequence
  Synthetic primer for O. sativa native SBPase amplification
gaacttcacagttggaaccatattt

SEQ ID NO: 78 - DNA, 19 bp, Artificial Sequence
  Synthetic primer for O. sativa native SBPase amplification
tagtgcgagggccatagat

SEQ ID NO: 79 - DNA, 21 bp, Artificial Sequence
  Synthetic primer for O. sativa ubq5 amplification
accacttcgaccgccactact

SEQ ID NO: 80 - DNA, 18 bp, Artificial Sequence
  Synthetic primer for O. sativa ubq5 amplification
acgcctaacctgctggtt

SEQ ID NO: 81 - protein, 387 aa, Glycine max
  DOMAIN (1)...(387): SBPase
METGIACYTRGPFLPSVSSKHSPPSISPSFGLRSLKSSSLFGESLRVASKSTIKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVTSPSAKAKLRLLFEVAPLGFLIEKAGGYSSDGHQSVLDKVITNIDERTQVAYGSKNEIIRFEETLYGKSRLKDGVAVGAAA

SEQ ID NO: 82 - protein, 393 aa, Hordeum vulgare subsp. vulgare
  DOMAIN (1)...(393): SBPase
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVITVLDERTQVAYGSKNEIIRFEETLYGSSRLAASATVGATA

SEQ ID NO: 83 - protein, 393 aa, Triticum aestivum
  DOMAIN (1)...(393): SBPase
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 84 - protein, 392 aa, Oryza sativa Indica Group
  DOMAIN (1)...(392): SBPase
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 85 - protein, 392 aa, Oryza sativa Japonica Group
  DOMAIN (1)...(392): SBPase
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVQDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 86 - protein, 393 aa, Setaria italica
  DOMAIN (1)...(393): SBPase
METVAAASYAGRATSATRSPTCCAAMSFSQSYRPKASRPPTTFYGESVRVSTARPLSARQSKAASRAALNTRCEIGDSLEEFLTKATPDKNLIRLLTCMGEAMRTIAFKVRTASCGGTACVNSFGDEQLAVDMLANKLLFDALEYSHVCKYACSEEVPELQDMGGPVEGGFSVAFDPLDGSSIVDTNFTVGTIFGVWPGDKLTGVTGGDQVAAAMGIYGPRTTYVIALKDCPGTHEFLLLDEGKWQHVKDTTSIGEGKMFSPGNLRATFDNPDYDKLINYYVKEKYTLRYTGGMVPDVNQIIVKEKGIFTNVTSPSAKAKLRLLFEVAPLGFLMEKAGGHSSDGKQSVLDKVINELDERTQVAYGSKNEIIRFEETLYGSSRLTAGATVGAAA

SEQ ID NO: 87 - protein, 392 aa, Oryza brachyantha
  DOMAIN (1)...(392): SBPase
METVAAAGYARGAATRSPACCAAMSFSQSYRAKAARPPSTFYGESLRVNTARPFLPGRQSKAASRAALNTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLPAGAAVGAAA

SEQ ID NO: 88 - protein, 383 aa, Sorghum bicolor
  DOMAIN (1)...(383): SBPase
MEIVATRSPACCAAVSFSQSYSRPKASRPATTFYGESVRVNTARPLSARQSKAVSRAALTTRCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGLLIEKAGGHSSDGKQSVLDKVINELDERTQVAYGSKNEIIRFEETLYGSSRLAAGATVGAAV

SEQ ID NO: 89 - protein, 369 aa, Triticum urartu
  DOMAIN (1)...(369): SBPase
MSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKVLVNYYVKEKYTLRYTGGMVPDVNQIIVKEKGIFTNVTSPTAKAKLLFEVAPLGFLIEKAGGHSSDGKQSVLDKVISVLDERTQVAYGSKNEIIRFEETLYGSSRLAASATVGATA

SEQ ID NO: 90 - protein, 385 aa, Zea mays
  DOMAIN (1)...(385): SBPase
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 91 - protein, 578 aa, Aegilops tauschii
  DOMAIN (1)...(578): SBPase
MCILHVTGKNNLQGIAGIKEWKYRTKNQSERPRKGPTPTRKSERLARRMVLMTSVLLTQRKKIGVGEQFQAEIPDWTGPPSDAELSWYRNDPNTSKMLGSRTWPPEGYVVQTNIVVAGQGRPESCNCPYPGNFYCRLHHINTARDRLRSEIGQVFKEWKFDLMGEQVSEMWSIEEQLKFAALEQLVPVFENKSFWAVAAKHFASKTRVDLVQYYLNVFLMRRVSNQCRLSLLEIDSDEDEAEEEEDEDQSDGSNSSQRPQDVQEEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISQLDERTQVAYGSKNEIIRFEETLYGSSRLAASATVGATA

SEQ ID NO: 92 - protein, 396 aa, Elaeis guineensis
  DOMAIN (1)...(396): SBPase
MKMETGVASYARGTIPHNVLRIPRLAAPSSAPSFPRSHRNHGLRASSLFGESLRVMSNSSPRNSKGAGNSSLITKCEIGDSLEEFLTKATPDKNLIRLLMSMGEALRTISFKVRTASCGGTACVNSFGDEQLAVDLLANKLLFEALQYSHVCKYACSEEVPELQDMGGAAEGGFSVAFDPLDGSSIVDTNFTVGTIFGVWPGDKLTGVTGRDQVAAAMGIYGPRTTYIIALKDCPGTHEFLLMDEGKWQHVKDTTSIGEGKMFSPGNLRATYDNPAYDKLINYYVREKYTLRYTGGMVPDVNQIIVKEKGIFTNVSSPTSKAKLRLLFECAPLGFLIEKAGGYSSDGTKSILDKVINNLDERTQVAYGSQNEIIRFEETLYGSSRILVGTPVGATV

SEQ ID NO: 93 - protein, 394 aa, Phoenix dactylifera
  DOMAIN (1)...(394): SBPase
MEAGVASYARGTIPHDVLRIPRVAAPSSAPSFSRSHRNHGLRSSSLFGESLRVMSKSSPRISKRAGSSSLITKCEIGDSLEEFLTKATPDKNLIRLLMSMGEALRTISFKVRTASCGGTACVNSFGDEQLAVDLVANKLLFEALQYSHVCKYACSEEVPELQDMGGAAEGGFSVAFDPLDGSSIVDTNFTVGTIFGVWPGDKLTGVTGRDQVAAAMGIYGPRTTYIIALKDCPGTHEFLLLDEGKWQHVKDTTSIGEGKMFSPGNLRATYDNPAYDKLINYYIRQKYTLRYTGGMVPDVNQIIVKEKGIFTNVTSPTSKAKLRLLFECAPLGFLIEKAGGYSSDGTKSILDKVINNLDDRTQVAYGSKNEIIRFEETLYGFSRVAAGTPVGAVV

SEQ ID NO: 94 - protein, 394 aa, Musa acuminata subsp. malaccensis
  DOMAIN (1)...(394): SBPase
METGAATCARGVIAHSVLYQSRLAVPSSAPSLPRSHRHSGLKSSSIFGDSLRLTPPKSRACRAVGSSSLATKCEIGDSLEEFLTKATPDKNLIRLLMAMGEALRTISFKVRTASCGGTACVNSFGDEQLAVDLLANNLLFEALQYSHVCKYACSEEVPELQDMGGPVEGGFSVAFDPLDGSSIVDTNFTVGTIFGVWPGDKLTGVTGRDQVAAAMGIYGPRTTYIIALKDCPGTHEFLLLDEGKWQHVKDTTSIGEGKIFSPGNLRATFDNPDYDKLINYYVREKYTLRYTGGMVPDVNQIIVKEKGIFTNVTSPSSKAKLRLLFEVAPLGFLIEKAGGYSSDGTRSVLDKVIENLDDRTQVAYGSKNEIIRFEETLYGSSRLNKAGAPVGAAA

SEQ ID NO: 95 - protein, 390 aa, Eucalyptus grandis
  DOMAIN (1)...(390): SBPase
METGVACYARGAFLPAKHSTSLVSPHSLSPSFTSKSLKSSSLFGESLRVGPPRSSLKASKAKNSSLTTRCEIGDSLEEFLNKATPDKGLIRLLVCMGEAIRTISFKVRTASCGGTACVNSFGDEQLAVDMLADKLLFEALQYSHFCKYACSEEVPELQDMGGPVQGGFSVAFDPLDGSSIVDTNFTVGTIFGVWPGDKLTGVTGRDQVAAAMGIYGPRTTYVLALKDCPGTHEFLLLDEGKWQHVKDTTEIGEGKMFSPGNLRATFDNPDYGKLIEYYVKEKYTLRYTGGMVPDVNQIIVKEKGVFTNVVSPSAKAKLRLLFEVAPLGFLIEKAGGFSSDGKQSVLDKVIINLDDRTQVAYGSKNEIIRFEEMLYGSSRLKAGVPVGAAA

SEQ ID NO: 96 - protein, 394 aa, Solanum lycopersicum
  DOMAIN (1)...(394): SBPase
METGVTCCARVTSLLPNVSSQQYSTSIATSRSISPSFNSRSLKSSSLFGESLRVAPKSSLKVSRTKNSSLVTKCEIGDSLEEFLSKSTSDKGLIRLMMCMGEALRTIAFKVRTASCGGTACVNSFGDEQLAVDMLADKLLFEALTYSHFCKYACSEEVPELQDMGGPAEGGFSVAFDPLDGSSIVDTNFTVGTIFGVWPGDKLTGITGREQVAAAMGIFGPRTTYVLALKDVPGTHEFLLLDEGKWQHVKDTTEIGEGKMFSPGNLRATFDNPDYAKLIEYYVKEKYTLRYTGGMVPDVNQIIVKEKGIFTNVTSPTAKAKLRLLFEVAPLGFLIEKAGGYSSDGKQSVLDKVIVNLDDRTQVAYGSKNEIIRFEETLYGSSRLKAGAPVGAAV

SEQ ID NO: 97 - protein, 392 aa, Fragaria vesca subsp. vesca
  DOMAIN (1)...(392): SBPase
MEASIACCSARAFLPGVSTQHSTALAAPSTISPSFSSKSLKATSLFGESLRQVPRSSLKVSKTKQSSLVTKCEIGDSLEEFLTKATPDKGLIRLMMCMGEAIRTISFKVRTASCGGTACVNSFGDEQLAVDMLADKLLFEALTYSHVCKYACSEEVPELQDMGGPVEGGFSVAFDPLDGSSIVDTNFTVGTIFGVWPGDKLTGVTGADQVAAAMGIYGPRTTYVLAIKGFPGTHEFLLLDEGKWQHVKETTEISEGKMFSPGNLRATFDNPDYDKLINYYVKEKYTLRYTGGMVPDVNQIIVKEKGVFTNVLSPTTKAKLRLLFEVAPLGLLVENAGGYSSDGHQSVLDKVIGKLDERTQVAYGSKNEIIRFEETLYGSSRLKGGVAVGAAA

SEQ ID NO: 98 - protein, 391 aa, Amborella trichopoda
  DOMAIN (1)...(391): SBPase
METGVLTYTCGTLVPHTSRPSSTPSLSRFINSQSSKCSAIYGESLRLSPKSQSRRTAKVGAGKSSSTITRCEIGDSLEEFLTKATPDKNLIRLLVSMGEALRTISFKVRTASCGGTACVNSFGDEQLAVDILANQLLFEALRYSHFCKYACSEEVPELQDMGGPVEGGFSVAFDPLDGSSIVDTNFTVGTIFGVWPGDKLTGVTGGDQVAAAMGIYGPRTTYVLALKDLPGTHEFLLLDEGKWQHVKDTTEIGEGKMFSPGNLRATSDNPDYAKLIDYYVKEKYTLRYTGGMVPDVNQIIVKEKGIFTNVTSPSAKAKLRLLFEVAPLGLLVEKAGGYSSDGKQSVLDKVISTLDERTQVAYGSKNEIIRFEETLYGSSRLKAGTPLAAAV

SEQ ID NO: 99 - protein, 388 aa, Cucumis melo
  DOMAIN (1)...(388): SBPase
METGIACCARGAFLPNLSSQHSTALMSPSFATRSLKASSLFGESLRQFPKSSVKVASRPKSVPLKTRCEIGDSLEEFLTKATPDKGLIRLLTCMGEALRTISFKVRTASCGGTACVNSFGDEQLAVDMLADKLLFEALRYSHFCKYACSEEVPELQDMGGPVEGGFSVAFDPLDGSSIVDTNFSVGTIFGVWPGDKLTGVKGSDQVAAAMGVYGPRTTYVLALKDFPGTHEFLLLDEGKWQHVKETTEIGEGKLFSPGNLRATFDNPDYDKLINYYVKEKYTLRYTGGMVPDVNQIIVKEKGIFTNVTSPSTKAKLRLLFEVAPLGFLVEKAGGYSSDGRRSVLDKVIENLDERTQVAYGSKEEIIRFEETLYGSSRFKSGVPVGAAV

SEQ ID NO: 100 - protein, 393 aa, Vitis vinifera
  DOMAIN (1)...(393): SBPase
METGVTCYARGAFLHTSVSSQHSTALVSPPSISPSFSSKSLRSSSLFGESLRVVPRSSLKVSRTKNSSLVTRCEVGDSLEEFLTKATPDKGLIRLMMCMGEALRTIAFKVRTASCGGTACVNSFGDEQLAVDMVANQLLFEALNYSHFCKHACSEEVPDLQDMGGPVEGGFSVAFDPLDGSSIVDTNFTVGTIFGVWPGDKLTGVTGRDQVAAAMGIYGPRTTYVLALKDIPGTHEFLLLDEGKWQHVKDTTEIGEGKLFSPGNLRATFDNPDYDKLINYYVREKYTLRYTGGMVPDVNQIIVKEKGIFTNVTSPSSKAKLRLLFEVAPLGFLIEKAGGFSSDGTQSVLDKVINNLDERTQVAYGSKNEIIRFEETLYGSSRLKAGVPVGAAV

SEQ ID NO: 101 - protein, 388 aa, Cucumis sativus
  DOMAIN (1)...(388): SBPase
METGIACCARGAFLPNLSSQHSTALMSPSFATRSLKASSLFGESLRQVSKSSVKVASRPKSVPLKTRCEIGDSLEEFLTKATPDKGLIRLLTCMGEALRTISFKVRTASCGGTACVNSFGDEQLAVDMLADKLLFEALRYSHFCKYACSEEVPELQDMGGPVEGGFSVAFDPLDGSSIVDTNFSVGTIFGVWPGDKLTGVKGSDQVAAAMGVYGPRTTYVLALKDFPGTHEFLLLDEGKWQHVKETTEIGEGKLFSPGNLRATFDNPDYDKLINYYVKEKYTLRYTGGMVPDVNQIIVKEKGIFTNVTSPSTKAKLRLLFEVAPLGFLVEKAGGYSSDGRQSVLDKVIENLDERTQVAYGSKEEIIRFEETLYGSSRFKSGVPVGAAA

SEQ ID NO: 102 - protein, 393 aa, Nicotiana sylvestris
  DOMAIN (1)...(393): SBPase
METSVTCCARTAALLPNVSSQHSTSLAAPRSISPSFSSRSLKSSSLFGESLRIAPKSSIKVSRTKNSSLVTKCEIGDSLEEFLTKSTSDKGLIRLMMCMGEAIRTIAFKVRTASCGGTACVNSFGDEQLAVDMLADKLLFEALSYSHFCKYACSEEVPELQDMGGPVEGGFSVAFDPLDGSSIVDTNFTVGTIFGVWPGDKLTGITGRDQVAAAMGIYGPRTTYVLALKDVPGTHEFLLLDEGKWQHVKDTTEIGEGKMFSPGNLRATFDNPDYAKLIDYYVKEKYTLRYTGGMVPDVNQIIVKEKGIFTNVISPTTKAKLRLLFEVAPLGFLIEKAGGYSSDGKQSVLDRVVVNLDDRTQVAYGSKNEIIRFEETLYGSSRLKSAEAVGATA

SEQ ID NO: 103 - protein, 394 aa, Nicotiana tomentosiformis
  DOMAIN (1)...(394): SBPase
MDTSVTCCARAALLPNVSSQQYSTTALAAPRSISPSFSIRSLKSSSLFGESLHVAPKSSLNVSKTKSYSLMTKCEIGDSLEEFLTKSTSDKGLISLMLCMGEALRTIAFKVRTASCGGTACVNSFGDEQLAVDMLANKLLFDALTYSHVCKYACSEEVPELQDMGGPAIGGFSVAFDPLDGSSIVDTNFTVGTIFGVWPGDKLTGITGRDQVAAAMGIFGPRTTYVVALKDVPGTHEFLLLDEGKWQHVKDTTEIGEGKMFSPGNLRATFDNADYAKLIDYYVKEKYTLRYTGGMVPDVNQIIVKEKGIFTNVTSPTAKAKLRLLFEVAPLGFLIEKAGGYSSDGKQSVLDKVIGTLDERTQVAYGSKNEIIRFEETLYGSSRLKAAEPVGAAA

SEQ ID NO: 104 - protein, 413 aa, Zea mays
  DOMAIN (1)...(413): FBPase
MAAAATTSSSSHLLLLSRQQAASLRCRLSFLGQPRRPGRVTAQAPAAKDVRCMAAVDTAASAAAAETSPKSSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 105 - protein, 406 aa, Setaria italica
  DOMAIN (1)...(406): FBPase
MAAAAATSSHLLLLSRQQAASLRCRLSFLGQSRRPASRGAASGASVRCMAAVDTAPAATEASSTKSSYEIVTLTTWLLKQEQAGVIDNEMTIVLASISTACKQIAALVQRAPISNLTGVQGAVNVQGEDQKKLDVVSNEVFSNCLKSSGRTGVIASEEEDVPVAVEESYSGNYIVVFDPLDGSSNIDAAVSTGSIFGIYAPNDECLADVENSGTLDSVEQRCVVSVCQPGSNLLAAGYCMYSSSVIFVLTLGAGVYVFTLDPMYGEFVLTQEKVQIPKAGKIYAFNEGNYALWDDKLKKYMDSLKEPGDSGKPYSARYIGSLVGDFHRTLLYGGIYGYPRDRKSKNGKLRLLYECAPMSFIVEQAGGKGSDGHQRILDITPTEIHQRVPLYIGSVEEVDKVEKFLA

SEQ ID NO: 106 - protein, 406 aa, Oryza sativa Japonica Group
  DOMAIN (1)...(406): FBPase
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 107 - protein, 408 aa, Oryza brachyantha
  DOMAIN (1)...(408): FBPase
MAAAAATTTSSHLLLLSRQQAAASLQCGLSFLRHPRRQQPGSGRLAGLRCMAAVDTASAPAATASKKSSYEITTLTTWLLKQEQAGAIDGEMTIVLSSISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIGDDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDKKSKNGKLRLLYECAPMSFIVEQAGGKGSDGHQRILDIMPTEIHQRVPLYIGSVEEVEKVEKFLA

SEQ ID NO: 108 - protein, 414 aa, Brachypodium distachyon
  DOMAIN (1)...(414): FBPase
MAAATTTTSRPLLLSRQQAAAAAGSLQCRLPRRSGLFAGQTSGAASMGPGVRCTAVVDTASAPAAAEPAKRKPSSYEIITLTTWLLKQEQAGTIDGEMTIVLSSISTACKQIASLVQRAPISNLTGVQGATNVQGEDQKKLDVVSNEVFSNCLRSSGRTGVIASEEEDVPVAVEESYSGNYIVVFDPLDGSSNIDAAVSTGSIFGIYSPADECLADIGENPTLDQVTEMCVVNVCQPGSNLLAAGYCMYSSSVIFVLTIGTGVYVFTLDPMYGEFVLTQEKVQIPKSGKIYSFNEGNYALWDDKLKSYMDSLKDPGTSGKPYSARYIGSLVGDFHRTMLYGGIYGYPRDQKSKNGKLRLLYECAPMSFIAEQAGGKGSDGHQRVLDIIPTEVHQRVPLYVGSVEEVEKVEKFLA

SEQ ID NO: 109 - protein, 359 aa, Oryza sativa Indica Group
  DOMAIN (1)...(359): FBPase
MAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQRSKNGKLRLLYECAPMSFIVEQAGGKGSDGHQRILDIMPTEIHQRVPLYIGSVEEVEKVEKFLA

SEQ ID NO: 110 - protein, 409 aa, Triticum aestivum
  DOMAIN (1)...(408): FBPase
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 111 - protein, 409 aa, Hordeum vulgare subsp. vulgare
  DOMAIN (1)...(409): FBPase
MAAATATTSRPLLLSRQQAAASSIQCRLPRRPGSSLFAGQAQASTPNVRCMAVVDTASAAAPAAAKKRNSYDMITLTTWLLKQEQDGVIDNEMTIVMSSISTACKQIASLVQRAPISNLTGVQGATNVQGEDQKKLDVISNEVFSNCLRWSGRTGVIASEEEDVPVSVEESYSGNYIVVFDPLDGSSNIDAAVSTGSIFGIYSPSDECHIGDDATIDEVTQMCIVNVCQPGSNLLAAGYCMYSSSVIFVLTIGTGVYVFTLDPMYGEFVLTQEKVQIPKSGKIYSFNEGNYALWDDKLKKYMDSLKDPGTSGKPYSARYIGSLVGDFHRTMLYGGIYGYPSDQKSKNGKLRLLYECAPMSFIAEQAGGKGSDGHQRVLDIMPTEVHQRVPLYVGSVEEVEKVEKFLSSD

SEQ ID NO: 112 - protein, 359 aa, Oryza coarctata
  DOMAIN (1)...(359): FBPase
MAAVDTASAPAATSASKKSSYEIITLTTWLLKQEQAGTIDGEMTIVLSSISTACKQIASLVQRAPISNLTGVQGAINVQGEDQKKLDVVSNEVFSNCLKSSGRTGVIASEEEDVPVAVEESYSGNYIVVFDPLDGSSNIDAAVSTGSIFGIYSPNDECLADISDDQNLDQVEERCIVSVCQPGSNLLAAGYCMYSSSVIFVLTVGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 113 - protein, 408 aa, Glycine soja
  DOMAIN (1)...(408): FBPase
MVAMAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 114 - protein, 411 aa, Jatropha curcas
  DOMAIN (1)...(411): FBPase
MAAITPPTSSHLLSASSRSLSRLSPFQLCVFDTKTLVSFPSNHISKKKHVAGGVKCMAVSTTSDAETKKKNMFEIQTLTNWLLKQEQAGVIDAELTIVLSSISMACKQIASLVQRASISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADVGDDNTLDSTEQRCIVNVCQPGSNLLAAGYCMYSSSVIFVITIGTGVYAFTLDPMYGEFVLTQEKIQIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSQEEVEKLEKYLA

SEQ ID NO: 115 - protein, 412 aa, Cucumis sativus
  DOMAIN (1)...(412): FBPase
MASAAATPSPCHVSSPVISRSLSRLSPFHLSLSSVVHPPCRGNRRHSGSSVSSTVRCAAVGAAKEAETKRKGTFQIETLTNWLLKQEQAGVIDAELTIVLSSISMACKQIASLVQRASISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDSTLGTTEQRCVVNVCQPGSNLLAAGYCMYSSSIIFVLTIGQGVFAFTLDPMYGEFVLTQEDIKIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 116 - protein, 410 aa, Glycine max
  DOMAIN (1)...(410): FBPase
MVAMAAATASSQLIFSKPRSPSRLCPFQLCVFDTKQVLSSSSGRRRHVGGSGVRCMAVGEAATTETKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 117 - protein, 412 aa, Cucumis melo
  DOMAIN (1)...(412): FBPase
MASAAATPSPCHVSSPVISRSLSRLSPFHLSLSSAVHPPCRGNRRHGGSTVSSTIRCAAVGAAKEAETKRKGTFQIETLTNWLLKQEQAGVIDAELTIVLSSISMACKQIASLVQRASISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDSTLGTIEQRCVVNVCQPGSNLLAAGYCMYSSSIIFVLTIGQGVFAFTLDPMYGEFVLTQEDIKIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 118 - protein, 413 aa, Elaeis guineensis
  DOMAIN (1)...(413): FBPase
MAVATISAVSQLLLSGGPTSRSLSHLSPFHLNLPGHQRTIFSAKQGPQRHGYAVIECAAVDTTATEVETKKKSSFELQTLTTWLLKQEQAGSIDSEMTIVLSSISIACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADMGDGSTLDQGEQKCVVSVCQPGSNLLAAGYCMYSSSIIFVLTVGKGVYAFTLDPMYGEFLLTQEQVKIPQAGKIYAFNEGNYQLWDDKLRRYMDSLKDPGPTGKPYSARYIGSLVGDFHRTLLYGGIYGYPRDKKSKNGKLRLLYECAPMSFIVEQAGGKGSDGHQRILDIEPQEIHQRVPLFIGSVEEVEKLEKFLA

SEQ ID NO: 119 - protein, 410 aa, Ricinus communis
  DOMAIN (1)...(410): FBPase
MVAVTTLPSSRLLFSTTRSLSPLSPSQLCAFDTSTLVSFPNSNSSKKKHVAAGVKCMAVSTESEAVTKRNTYEIQTLTNWLLKQEQAGVIDAELTIVLSSISMACKQIASLVQRASISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLADIGDDNTLDNAEQRCIVNVCQPGSNLLAAGYCMYSSSVIFVLTIGTGVFAFTLDPMYGEFVLTQEKIQIPKAGKIYAFNEGNYQLWDNKLKKYIDDLKDPGPSGKPYSARYIGSLVGDFHRTLLYGGIYGYPRDKKSKNGKLRLLYECAPMSFIVEQAGGKGSDGHQRILDIQPVEIHQRVPLYIGSLEEVDKLEKYLA

SEQ ID NO: 120 - protein, 410 aa, Fragaria vesca subsp. vesca
  DOMAIN (1)...(410): FBPase
MVAAAVTPSSSQLLCSSSRSISQLSPLQQCVFGSKASTATTPNSSKRNRGVGSVGVKCMAVAAETEPKKKTAYQITTLTSWLLEQEQKGTIDAELTIVLSSISLACKQIASLVQRASISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLADIDDENLDSAAQKCIVSVCQPGSNLLAAGYCMYSSSVIFVLTVGKGVYAFSLDPMYGEFVLTQEKVQIPKAGKIYSFNEGNYQLWDDKLKKYIDDLKDPGPSGKPYSARYIGSLVGDFHRTLLYGGIYGYPRDRKSKNGKLRLLYECAPMSFIVEQAGGKGSDGHSRVLDIQPTEIHQRVPLYIGSVDEVEKLEKYLA

SEQ ID NO: 121 - protein, 408 aa, Sesamum indicum
  DOMAIN (1)...(408): FBPase
MAAATATTAAAHLLFTTSQSISRFSPFQTLASCPNGSGGVVRRRHMGPRGGGVRCMAVAAEAESKKKSGYEIETLTNWLLKQEQAGTIDAELTIVISSISMACKQIASLVQRASISNLTGIQGAVNVQGEDQKKLDVVSNEVFSNCLRSSGRTGIIASEEEDVPVAVEESYSGNYIVVFDPLDGSSNIDAAVSTGSIFGIYSPNDECLADIGDDAELGNVEQRCVVNVCQPGNNLLAAGYCMYSSSVIFVITLGKGVFAFTLDPMFGEFVLTQENVQIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHHRILDIQPTEIHQRVPLYIGSVEEVEKLEKYLA

SEQ ID NO: 122 - protein, 414 aa, Populus euphratica
  DOMAIN (1)...(414): FBPase
MVAQAAAITTSSSHLLFLTSCSLSRPSPSQLCVFDSKTLVPYPNSTSTYKKKRGGDGLKCMAVSTASEAKTKKSTFEIQTLTGWLLKQEQAGVIDAELTIVISSISMACKQIASLVQRASISNLTGVQGAVNIQGEDQKKLDVVSNEVFSSCLRSSGRTGIIASEEEDVPVAVEESYSGNYIVVFDPLDGSSNIDAAVSTGSIFGIYSPNDECLADIGDDSTLDQTEQRCIVNVCQPGNNLLVAGYCMYSSSVIFVLTIGKGVFSFSLDPMYGEFVLTQENIQIPKAGKIYSFNEGNYQLWDDKLKKYIDDLKDPGPSGKPYSARYIGSLVGDFHRTLLYGGIYGYPRDKKSKNGKLRLLYECAPMSFIVEQAGGKGSDGHQRVLDITPNEIHQRVPLYIGSVEEVEKLEKYLA

SEQ ID NO: 123 - protein, 411 aa, Medicago truncatula
  DOMAIN (1)...(411): FBPase
MVAMAAATASSQLIFSKPCSPSRLCPFQLCVFDTKSVLSSSRRKHVSGSGGVRCMAVGEVAAETKKRSSYELITLTSWLLKQEQTGVIDAELTIVLNSISLACKQIASLVQRANISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLADVGNESDDPTLGTEEQRCIVNVCQPGSNLLAAGYCMYSSSVIFVLTIGKGVFVFTLDPMYGEFVLTQENLQIPKSGKIYSFNEGNYKLWDDNLKKYIDDLKEPGANGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 124 - protein, 414 aa, Eucalyptus grandis
  DOMAIN (1)...(414): FBPase
MVSAATSAAVPHRLLSNPSCSLSSLSSFKLCTLDSRALVSLKKRHVGSAGAAAGGVRCMAVATETAGTAKKKKSGYDILTLTTWLLQQEKEGVIDAELTIVLSSISMACKQIASLVQRAGISNLTGVQGAVNVQGEDQKKLDVVSNEVFSSCLRSSGRTGIIASEEEDVPVAVEESFSGNYIVVFDPLDGSSNIDAAVSTGSIFGIYSPNDECLADIGDDENLDNAEQRCVVNVCQPGDNLLAAGYCMYSSSVIFVITIGKGVYAFTLDPMYGEFVLTQENIQIPKAGKIYSFNEGNYQLWDDKLKKYIDDLKDPGPTGKPYSARYIGSLVGDFHRTLLYGGIYGYPRDKKSKNGKLRLLYECAPMSFIVEQAGGKGSDGHQRVLDIQPVEIHQRVPLYIGSVEEVEKLEKYLA

SEQ ID NO: 125 - protein, 412 aa, Gossypium raimondii
  DOMAIN (1)...(412): FBPase
MVAAVAATASSQLLVSSSRSLSRLSPFQLCVFDSKTLVSCPSNGNGSNNSIKRRHVRCMAVGTAPEAETKKSGFEIQTLTGWLLKQEQAGTIDAELTIVLSSISMACKQIASLVQRASISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLAEIDDDSTLGSAEQRCVVNVCQPGSNLLAAGYCMYSSSIIFVLTLGNGVYAFTLDPMYGEFVLTQEKIQIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPVEIHQRVPLYIGSQEEVEKLEKYLA

SEQ ID NO: 126 - protein, 395 aa, Glycine max
  DOMAIN (1)...(395): FBP aldolase
MASASATLLKSSPVLDKCEWVKGQTLRQPLVRCNPSSASALTIKAASYADELVKTAKTVASPGRGILAMDESNATCGKRLASIGLENTEANRQAYRTLLVTVPGLGEYISGAILFEETLYQSTVDGRKIVDVLVDQNIVPGIKVDKGLVPLAGSNDESWCQGLDGLASRSAAYYQQGARFAKWRTVVSIPNGPSALAVKEAAWGLARYAAISQENGLVPIVEPEILLDGEHGIDRTFEVAQKVWSEVFFYLAENNVLLEGILLKPSMVTPGAESKDKATPLQVADYTLKLLHRRIPPAVPGIMFLSGGQSEVEATLNLNAMNQSPNPWHVSFSYARALQNTCLKTWGGLPENVKAAQDALLFRAKSNSLAQLGKYTAEGESEEATRGMFVKGYSY

SEQ ID NO: 127 - protein, 389 aa, Sorghum bicolor
  DOMAIN (1)...(389): FBP aldolase
MVAASLLKSSFLPKKSEWGATRQAAASPRPATVSVVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAEYTLKLLHRRIPPSVPGIMFLSGGQSEVEATQNLNAMNQGTNPWHVSFSYARALQNTCLKTWGGQPEKVTAAQDALLLRAKANSLAQLGKYTSDGEAAEAKEGMFVKNYSY

SEQ ID NO: 128 - protein, 388 aa, Setaria italica
  DOMAIN (1)...(388): FBP aldolase
MASATLLKSSFLPKKSEWGAARQLTAPRPVTVSVVVRASAYADELVKTAKTIASPGRGILAMDESNATCGKRLASIGLENTEANRQAYRTLLVTAPGLGNYISGAILFEETLYQSAVDGRRIVDILTEQGIVPGIKVDKGLVPLAGSNDESWCQGLDGLAAREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAEYTLKLLHRRIPPSVPGIMFLSGGQSEVEATQNLNAMNQGPNPWHVSFSYARALQNTCLKTWGGVPENVKAAQDALLLRAKANSLAQLGKYTSDGEAAEAKEGMFVKNYSY

SEQ ID NO: 129 - protein, 388 aa, Oryza sativa Japonica Group
  DOMAIN (1)...(388): FBP aldolase
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 130 - protein, 388 aa, Oryza brachyantha
  DOMAIN (1)...(388): FBP aldolase
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLTGSNNESWCQGLDGLASREAAYYQQGARFAKWRTVVSIPNGPSELAVKEAAWGLARYAAISQDNGLVPIVEPEILLDGEHGIDRTFEIAQKVWAEVFFYMAENNVMFEGILLKPSMVTPGAECKDRATPEQVADYTLKLLHRRIPPAVPGIMFLSGGQSEVEATQNLNAMNQGANPWHVSFSYARALQNTCLKTWGGQPENVKAAQDALLLRAKANSLAQLGKYTSDGEAAEAKEGMFVKNYVY

SEQ ID NO: 131 - protein, 388 aa, Aegilops tauschii
  DOMAIN (1)...(388): FBP aldolase
MASATLLKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 132 - protein, 388 aa, Hordeum vulgare subsp. vulgare
  DOMAIN (1)...(388): FBP aldolase
MASATLLKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAAAKENMFVKNYSY

SEQ ID NO: 133 - protein, 388 aa, Sorghum bicolor
  DOMAIN (1)...(388): FBP aldolase
MASATLLKSSFLPKKAEWGAMRQAATPKPVTVSMVVRASAYADELVQTAKTIASPGRGILAMDESNATCGKRLDSIGLENTEANRQAYRTLLVSAPGLGQYISGAILFEETLYQSTVDGKKIVDVLNEQGIVPGIKVDKGLVPLAGSNNESWCQGLDGLASREAAYYQAGARFAKWRTVVSIPNGPSELAVKEAAWGLARYAAISQENGLVPIVEPEILLDGEHGIERTFEVAQKVWAETFYYMAENNVMFEGILLKPSMVTPGAECEEKATPEQVAEYTLKLLHRRIPPAVPGIMFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 134 - protein, 388 aa, Triticum aestivum
  DOMAIN (1)...(388): FBP aldolase
MASATLLKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANYLAQLGKYTSDGEAAEASENMFVKNYSY

SEQ ID NO: 135 - protein, 388 aa, Triticum urartu
  DOMAIN (1)...(388): FBP aldolase
MASATLLKSSFLPKKAEWGTMRQAAAPKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 136 - protein, 388 aa, Brachypodium distachyon
  DOMAIN (1)...(388): FBP aldolase
MASATILKSSFLPKKSEWGATRQAATPKQMTVSMVVRASAYADELVKTANTIASPGRGILAMDESNATCGKRLDSIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEILLDGEHGIDRTFEVAQKVWAETFYYMAQNNVLFEGILLKPSMVTPGAECKERATPEQVASYTLKLLQRRIPPSVPGIMFLSGGQSEVEATLNLNAMNQSPNPWHVSFSYARALQNTCLKTWGGRPENVAAAQEALLLRAKANSLAQLGKYTSDGEAAAAKEGMFVKNYSY

SEQ ID NO: 137 - protein, 388 aa, Avena sativa
  DOMAIN (1)...(388): FBP aldolase
MASATLLKSSFLPKKSEWGVTRQAAAPKPMTVSMVVRASAYADELVKTAKTVASPGRGILAMDESNATCGKRLASIGLENTEANRQAYRTLLVTPPGLGNYISGAILFEETSTSRLLMGRRLLTSLSSRVIVPGIKVDKGLVPLVGSNDESWCQGLDGLASREAAYYQQGARFAKWRTVVSIPNGPSELAVKEAAWGLARYAAISQDNGLVPIVEPESHVDGEHGIERTFEVAQKVWAETFFYMAQNNVMFEGILLKPSMVTPGAECKDRATPEEVASYTLKLLHRRIPPSVPGIMFLSGGQSVVEATLNLNAMNQAPNPWHVSFSYARALQNTCFKTWGGRPENVAAAQEALLLRAKANSLAQLGKYTSDGEAAAAKEGMFVKNYSY

SEQ ID NO: 138 - protein, 388 aa, Elaeis guineensis
  DOMAIN (1)...(388): FBP aldolase
MASATLLKSSFLPKKSEWLNARPSSTSQPMAVSFTVRAGAYADELVKTAKTVASPGRGILAMDESNATCGKRLASIGLENTEANRQAYRTLLITAPGLGQYVSGAILFEETLYQSTTDGKKMVDVLVSQNIMPGIKVDKGLVPLAGSNDESWCQGLDGLASRCAAYYQQGARFAKWRTVVSIPNGPSALAVKEAAWGLARYAAIAQDNGLVPIVEPEILLDGDHGIERTFEVAQKVWAEVFFYMAENNVMYEGILLKPSMVTPGAECKERATPEQVAEYTLKLLHRRIPPAVPGIMFLSGGQSEVEATLNLNAMNQSPHPWHVSFSFARALQNTCLKTWGGRPENVKAAQDALLIRAKANSLAQLGKYTGEGESAEAKEGMYVKNYSY

SEQ ID NO: 139 - protein, 388 aa, Phoenix dactylifera
  DOMAIN (1)...(388): FBP aldolase
MASAALLKSSFLPKKSEWLNARPSSSAQPMAVSFTVRAGAYTDELVKTAKTIASPGRGILAMDESNATCGKRLASIGMENTEANRQAYRTLLVTAPGLGQYISGAILFEETLYQSTTDGKKMVDVLVKQNIMPGIKVDKGLVPLVGSNDESWCQGLDGLASRCAAYYQQGARFAKWRTVVSIPNGPSALAVKEAAWGLARYAAIAQDNGLVPIVEPEILLDGEHGIERTFEVAQKVWAEVFFYMAENNVMYEGILLKPSMVTPGAECKEKASPEQVAEYTLKLLHRRIPPSVPGIMFLSGGQSEVEATLNLNAMNQSPNPWHVSFSYARALQNTCLKTWGGRPENVKAAQDTLLVRAKANSLAQLGKYTGEGESAEAKEGMYVKNYSY

SEQ ID NO: 140 - protein, 388 aa, Musa acuminata subsp. malaccensis
  DOMAIN (1)...(388): FBP aldolase
MASAALLKSSFLPKRSEWHTTRKSSTPQPTVIAFSVRAGAYSDELVKTAKSIASPGRGILAMDESNATCGKRLATIGLENTEANRQAYRTLLVSAPGLGQYISGAILFEETLYQSTTDGKKMVDVLTQQNIMPGIKVDKGLVPLTGSNDESWCQGLDGLASRCAAYYQQGARFAKWRTVVSIPNGPSALAVKEAAWGLARYAAIAQDNGLVPIVEPEILLDGDHGIERTFEVAQKVWAEVFFYLAENNVMFEGILLKPSMVTPGAECPEKATPKQVAEYTLKLLHRRIPPAVPGIMFLSGGQSEVEATFNLNAMNQGPNPWHVSFSYARALQNTCLKTWGGRPENVKAAQDALLFRAKANSLAQLGKYTGEGESAEATKGMFVKGYTY

SEQ ID NO: 141 - protein, 396 aa, Populus euphratica
  DOMAIN (1)...(396): FBP aldolase
MASASLLKSSPVLDKSEFVKGQTLRLPSASIVRCRSTTPSSLTVRAGSYADELVKTAKTIASPGRGILAMDESNATCGKRLASIGLENTEANRQAYRTLLVTVPGLGNYVSGAILFEETLYQSTTDGKKMVDVLVEQKIVPGIKVDKGLVPLAGSNDESWCQGLDGLASRSAAYYQQGARFAKWRTVVSIPNGPSALAVKEAAWGLARYAAISQDNGLVPIVEPEILLDGEHGIERTFEVAQKVWAEVFYYMAENNVMFEGILLKPSMVTPGAECKDRATPDQVAEYTLKLLHRRIPPAVPGIMFLSGGQSEVEATLNLNAMNQSPNPWHVSFSYARALQNTCLKTWGGRPENVQAAQEALLIRAKANSLAQLGKYTGEGESDEAKKGMYVKNYSY

SEQ ID NO: 142 - protein, 396 aa, Nelumbo nucifera
  DOMAIN (1)...(396): FBP aldolase
MASASLLKSSPVLDNSEWVKGQTLRQPSASVVRCHPVSQSALTIRAGSYADELVKTAKTIASPGRGILAMDESNATCGKRLASIGLENTEANRQAYRTLLVTAPGLGNYVSGAILFEETLYQSTVDGRKMVDVLVEQKIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVMFEGILLKPSMVTPGAECKDKASPQQVAEYTLKLLHRRIPPAVPGIMFLSGGQSEVEATLNLNAMNQGPNPWHVSFSYARALQNTCLKTWGGRPENVQAAQEALLIRAKANSLAQLGKYTGEGESEEAKKGMFVKGYTY

SEQ ID NO: 143 - protein, 396 aa, Carica papaya
  DOMAIN (1)...(396): FBP aldolase
MASASFLKSSPVLDKSEWIKGQTLRQPSVSVVRCQPVAPSSLLVRASSYADELVKTAKTIASPGRGILAMDESNATCGKRLASIGLENTEANRQAYRTLLVSAPGLGQYISGAILFEETLYQSTTEGKKMVDVLVEQNIVPGIKVDKGLVPLAGSNNESWCQGLDGLASRSAAYYQQGARFAKWRTVVSIPNGPSALAVKEAAWGLARYAAISQDNGLVPIVEPEILLDGDHGIDRTFEVAQKVWAEVFFYLAENNVMFEGILLKPSMVTPGAECKDRATPEQVADYTLKLLSRRIPPAVPGIMFLSGGQSEVEATLNLNAMNQSPNPWHVSFSYARALQNTCLKTWGGRPENVKAAQDSLLVRAKANSLAQLGKYTGEGESEEAKKGMFVKGYVY

SEQ ID NO: 144 - protein, 397 aa, Gossypium raimondii
  DOMAIN (1)...(397): FBP aldolase
MASASATLLKSSPIIDKSEWIKGQNLRHPSVCFVRSHPTSVAFTVRASSYADELVKTAKTVASPGRGILAMDESNATCGKRLASIGLENTEANRQAYRTLLVSAPGLGDYISGAILFEETLYQSTIDGKKMVDVLVEQKIVPGIKVDKGLVPLPGSNNESWCQGLDGLSSRTAAYYQQGARFAKWRTVVSIPNGPSALAVKEAAWGLARYAAISQDSGLVPIVEPEILLDGDHGIDRTFEVAQKVWAEVFFYLAENNVMFEGILLKPSMVTPGAECKDKATPQQVADYTLKLLHRRIPPAVPGIMFLSGGQSEVEATLNLNAMNQSPNPWHVSFSYARALQNTCLKTWGGRPENVKAAQDALLVRAKANSLAQLGKYTGEGESEEAKKGMFVKGYVY

SEQ ID NO: 145 - protein, 397 aa, Eucalyptus grandis
  DOMAIN (1)...(397): FBP aldolase
MASASATLLKSSPVLDKSEWVKGQSIRHASATTVRCHPAAASVLTVKASYADELVKTAKTIASPGRGILAMDESNATCGKRLASIGLENTEANRQAYRTLLVTVPGLGEYISGAILFEETLYQSTVDGRKMVDVLVEQNIVPGIKVDKGLVPLAGSNNESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVMFEGILLKPSMVTPGAECKDKATPQQVAEYTLKLLHRRIPPAVPGIMFLSGGQSEVEATLNLNAMNQSPNPWHVSFSYARALQNTCLKTWGGRPENVKPAQETLLVRAKANSLAQLGKYTGEGESEEAKKGMFVKGYVY

SEQ ID NO: 146 - protein, 396 aa, Populus trichocarpa
  DOMAIN (1)...(396): FBP aldolase
MASASLLKSSPVLDKSEFVKGQTLRLPSASIVRCRSTAPSSLTVRAGSYADELVKTAKTIASPGRGILAMDESNATCGKRLASIGLENTEANRQAYRTLLVTVPGLGNYVSGAILFEETLYQSTTDGKKMVDVLVEQKIVPGIKVDKGLVPLAGSNDESWCQGLDGLASRSAAYYQQGARFAKWRTVVSIPNGPSALAVKEAAWGLARYAAISQDNGLVPIVEPEILLDGEHGIERTFEVAQKVWAEVFYYMAENNVMFEGILLKPSMVTPGAECKDRASPDQVAEYTLKLLHRRIPPAVPGIMFLSGGQSEVEATLNLNAMNQSPNPWHVSFSYARALQNTCLKTWGGRPENVQAAQETLLIRAKANSLAQLGKYTGEGESDDAKKGMYVKNYSY

SEQ ID NO: 147 - protein, 398 aa, Theobroma cacao
  DOMAIN (1)...(398): FBP aldolase
MASASATLLKSSPILDKSEWVKGQNLRQPSVSVVRCHPTAPSALTVRASSYADELIKTAKTIASPGRGILAMDESNATCGKRLASIGLENTEANRQAYRTLLVSAPGLGEYISGAILFEETLYQSTTDGKKMVDVLVEQNIVPGIKVDKGLVPLPGSNNESWCQGLDGLSSRTAAYYQQGARFAKWRTVVSIPNGPSALAVKEAAWGLARYAAISQDSGLVPIVEPEILLDGEHGIDRTFEVAKKVWAEVFFYLAENNVMFEGILLKPSMVTPGAECKEKATPQQVADYTLKLLHRRIPPAVPGIMFLSGGQSEVEATLNLNAMNQSPNPWHVSFSYARALQNTCLKTWGGRPENVKAAQEVLLVRAKANSLAQLGKYTGEGESEEAKKGMFVKGYVY

SEQ ID NO: 148 - protein, 398 aa, Phaseolus vulgaris
  DOMAIN (1)...(398): FBP aldolase
MASASPSLLKSSLVLDKSEWVKGQTLRQPSASVVRCSPTNPSALTIRAGSYADELVKTAKIVASPGRGILAMDESNATCGKRLASIGLENTEANRQAYRTLLVTVPGLGQYISGAILFEETLYQSTIDGKKIVDVLQEQKIVPGIKVDKGLVPLAGSNDESWCQGLDGLASRSAAYYQQGARFAKWRTVVSIPNGPTALAVKEAAWGLARYAAISQDNGLVPIVEPEILLDGEHTIDRTFEVAQKVWAEVFFYLAENNVLFEGILLKPSMVTPGAQSKEKVSPETVADYTLKLLHRRIPPAVPGIMFLSGGQSEVEATLNLNAMNQSPNPWHVSFSYARALQNTALKTWGGLPEQVKASQDALLFRAKSNSLAQLGKYTGEGESEEAKKELFVKGYSY

SEQ ID NO: 149 - protein, 397 aa, Nicotiana tomentosiformis
  DOMAIN (1)...(397): FBP aldolase
MASASLLKSSPVFDKSEFVKGQTLRQPSVSVIRCHPTTAPCLTVRAACSYADELVKTAKTIASPGRGILAMDESNATCGKRLASIGLENTEANRQAYRTLLITAPGLGQYVSGAILFEETLYQSTTDGRKMVDVLVEQNIVPGIKVDKGLVPLAGSNDESWCQGLDGLASRTAAYYQQGARFAKWRTVVSIPNGPSALAVKEAAWGLARYAAIAQDSGLVPIVEPEILLDGEHGIDRTFEVAQQVWAEVFFYLAENNVMFEGILLKPSMVTPGAECKDRATPEQVADYTLKLLHRRIPPAVPGIMFLSGGQSEVEATLNLNAMNQAPNPWHVSFSYARALQNTCLKTWGGLPENVKAAQDALLVRAKANSLAQLGKYTGEGESDEAKKGMFVKGYVY

SEQ ID NO: 150 - protein, 397 aa, Solanum lycopersicum
  DOMAIN (1)...(397): FBP aldolase
MASASLLKSSPVLDKSEFLKGQSLRQPSVSVVRCHPTNATSLTVRAASSYADELIKTAKTVASPGRGILAMDESNATCGKRLASIGLENTEANRQAYRTLLVSAPGLGQYISGAILFEETLYQSTVDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGAECKDRATPQQVADYTLSLLKRRIPPAVPGIMFLSGGQSEVEATLNLNAMNQAPNPWHVSFSYARALQNTCLKTWGGQPENVKAAQDTLLVRAKANSLAQLGKYTGEGESDEAKQGMFVKGYVY

SEQ ID NO: 151 - protein, 399 aa, Glycine max
  DOMAIN (1)...(399): FBP aldolase
MASASASLLKSSLVLDKSEWVKGQTLRQPSAASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYQQGARFAKWRTVVSIPNGPSALAVKEAAWGLARYAAIAQDNGLVPIVEPEILLDGEHGIDRTFEVAKKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALLFRAKSNSLAQLGKYTGEGESEEAKKELFVKGYSY

SEQ ID NO: 152 - protein, 396 aa, Vitis vinifera
  DOMAIN (1)...(396): FBP aldolase
MASASLLKSSPVLDKSEWVKGQSLRQPSVSVVRCNPVAPSVLTIRAGSYADELVKTAKTIASPGRGILAMDESNATCGKRLASIGLENTEANRQAYRTLLVTAPGLGNYISGAILFEETLYQSTTDGKKMVDVLVEQKIVPGIKVDKGLVPLVGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGAECKDKATPEQVAQYTLKLLSRRIPPAVPGIMFLSGGQSEVEATLNLNAMNQAPNPWHVSFSYARALQNTCLKTWGGRPENVKEAQDTLLLRAKANSLAQLGKYTGEGESEESKQGMFVKGYVY

SEQ ID NO: 153 - protein, 398 aa, Medicago sativa
  DOMAIN (1)...(398): FBP aldolase
MASASASLFKSSIVLDKSEWVKGQTLRQSSVSAVRCSPAAPSSLTIRAGSYADELVKTAKTIASPGRGILAMDESNATCGKRLASIGLENTEVNRQAWRTLLVTVPSLGEYISGAILFEETLYQSTTDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVQFEGILLKPSMVTPGAECKDKASPATVADYTLKLLHRRIPPAVPGIMFLSGGQSEVEATLNLNAMNQSPNPWHVSFSYARALQNTALKTWGGRIENVQAAQEALLFRAKSNSIAQLGKYTGEGESEEAKKELFVKGYSY

SEQ ID NO: 154 - protein, 398 aa, Nicotiana tabacum
  DOMAIN (1)...(398): FBP aldolase
MASASLLKSSPTVIDKSEFVKGQSLRQTSVSVVRCHPTNASSLTVRAASPYADELVKTAKTVASPGRGILAMDESNATCGKRLASIGLENTEANRQAYRTLLVTAPGLGQYISGAILFEETLYQSTVDGRKIVDVLVEQNIVPGIKVDKGLVPLAGSNDESWCQGLDGLASRTAAYYQQGARFAKWRTVVSIPNGPSALAVKEAAWGLARYAAISQDSGLVPIVEPEILLDGEHGIDRTFEVAQKVWAEVFFYLAENNVMFEGILLKPSMVTPGAECKDRATPQQVADYTLSLLQRRIPPAVPGIMFLSGGQSEVEATLNLNAMNQAPNPWHVSFSYARALQNTCLKTWGGQPENVKAAQDALLTRAKANSLAQLGKYTGEGESDEAKQGMFVKGYVY

SEQ ID NO: 155 - protein, 397 aa, Solanum tuberosum
  DOMAIN (1)...(397): FBP aldolase
MASASLLKSSPVLDKSEFLKGQSLRQPSVSVVRCHPINATSLTVRAASSYADELIKTTKTVASPGRGILAMDESNATCGKRLASIGLENTEANRQAYRTLLVSAPGLGQYISDAILFEETLYQSTVDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGAECKDRATPQQVADYTLNLLKRRIPPAVPGIMFLSGGQSEVEATLNLNAMNQAPNPWHVSFSYARALQNTCLKTWGGQPENVKAAQDTLLVRAKANSLAQLGKYTGEGESDEAKQGMFVKGYVY

SEQ ID NO: 156 - protein, 527 aa, Solanum tuberosum
  DOMAIN (1)...(527): AGPase (large subunit)
MDTCCVPMKSTVHLGRVSTGGFNNGEKEFFGEKIRGSLNSNLRINQLSKSLKLEKKENKIKPGVAYSVITTENDTQTVFVDMPRLERRRANPKDVAAVILGGGKGTKLFPLTSRTATLAVPVGGCYRLIDIPMSNCINSAINKIFVLTQYNSAPLNRHIARTYFGNGVSFGDGFVEVLAATQTPGEAGKKWFQGTADAVRKFIWVFEDAKNKNIENIVVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGIIIILEKATIRDGTVI

SEQ ID NO: 157 - protein, 524 aa, Solanum lycopersicum
  DOMAIN (1)...(524): AGPase (large subunit)
MDTCCAAMKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 158 - protein, 528 aa, Nicotiana tomentosiformis
  DOMAIN (1)...(528): AGPase (large subunit)
MDTCCVALKSTAHLGRVSKGGFENGEKEFLGEQIRGSLNNNNLRVNNLSKSLKLEKKESKIKPGVAFSVITTENGKETLTVEAPRFDRRRANPKNVASVILGGGAGTKLFPLTSRAATPAVPVGGCYRLIDIPMSNCINSGINKIFVLTQYNSAPLNRHIARTYFGNGVSFGDGFVEVLAATQTPGETGKKWFQGTADAVRQFIWVFEDAKNKDIDNILILSGDHLYRMDYMDLVQNHIDRNSDITLSCAPAGDSRASDFGLVKIDSRGRVVQFAEKPKGFDLKTMQVDTTLIGLSPQEAKRSPYIASMGVYVFKTDVLLKLLKWRYPTANDFGSEIIPAAINEHNVQAYIFRDYWEDIGTIKSFYDANLALTAEFPKFEFYDPKTPFYTSPRFLPPTKIDNCKIKDAIISHGCFLRECSVDHSIVGERSRLDCGVELKDTLMMGADYYQTESEIASLLAEGKVPIGIGENTKIRNCIIDKNAKIGKDVVIMNKDGVQEADRPEEGFYIRGGLTIIAEKATIKDGTVI

SEQ ID NO: 159 - protein, 528 aa, Nicotiana sylvestris
  DOMAIN (1)...(528): AGPase (large subunit)
MDTCFVALKSTAHLGRVSKGGFENGEKEFLGEQIRGSLNNNNLRVNNLSKSLKLEKKESKIKPGVAFSVITTENGKETLTVEAPRFDRRRANPKNVASVILGGGAGTKLFPLTSRAATPAVPVGGCYRLIDIPMSNCINSGINKIFVLTQYNSAPLNRHIARTYFGNGVSFGDGFVEVLAATQTPGETGKKWFQGTADAVRQFIWVFEDAKNKDVDNILILSGDHLYRMDYMDLVQNHIDRNSDITLSCAPACDSRASDFGLVKIDSRGRVVQFAEKPKGFDLKAMQVDTTLIGLSPQEAKRSPYIASMGVYVFKTDVLLKLLKWRYPTANDFGSEIIPAAINEHNVQAYIFRDYWEDIGTIKSFYDANLALTAESPKFEFYDPKTPFYTSPRFLPPTKIDNCKIKDAIISHGCFLRECSVDHSIVGERSRLDCGVELKDTLMMGADYYQTESEIASLLAEGKVPIGVGENTKIRNCIIDKNAKIGKDVVIMNKDGVQEADRPEEGFYIRAGLTIVAEKATIKDGTVI

SEQ ID NO: 160 - protein, 526 aa, Sesamum indicum
  DOMAIN (1)...(526): AGPase (large subunit)
MDSCATLKPTAHLGNLSKGGFGNGEKGIWGEKIRGSLSSCGWANQLGRSLSLENKGRKIKPGVAYSVLTRENNKETVTVQTPIPERRRANPKNVAAIILGGGAGKHLFPLTNRAATPAVPVGGCYRLIDIPMSNCINSGINKIFVLTQFNSASLNRHISRTYTGNGISFGDGFVEVLAATQTAGETGNRWFQGTADAVRQFIWLFEDAKAKDIDNVLILSGDHLYRMDYMDFVQNHIDRNADLTLSCAPVDDSRASSFGLVKIDSRGRITQFSEKPRGSDKKAMQVDTSIIGLSPQEALRSPYIASMGVYAFKTNVLLKLLRWSYPTANDFGSEIIPAAVKEQNVQAYIFRDYWEDIGTIKSFYDANLALTDEFPKFEFYDPKTPFYTSPRFLPPTKIDNCKIKDAIISHGCFLRECIVEHSIVGERSRLDSGVELKDSLMMGADYYQTESEIASLLAQGKVPMGIGRNTKIRNCIIDKNARIGKDVIIKNKDGVQEADRPEEGFYIRSGITIIVEKATISDGTVI

SEQ ID NO: 161 - protein, 517 aa, Ipomoea batatas
  DOMAIN (1)...(517): AGPase (large subunit)
MEFCATLKSSAHLPRETEFFGGRIRGSLNNNVLLSQSRKSLRLDGNKRKIKPGVAFSVLTRENGTETLTVEAPILERRRANPKNVAAIILGGGAGTHLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 162 - protein, 527 aa, Vitis vinifera
  DOMAIN (1)...(527): AGPase (large subunit)
MDSCCVTFKAKAHLAKASRGGLSNGDNEFWGERIRGSLNNSGWVSQLAKGLKTEKRPRKIKPGVACSVITSNNGKETVTIQAPIFERRRADPKNVASIILGGGAGTQLFPLTIRQATPAVPVGGCYRLIDIPMSNCINSNINKIFILTQFNSASLNRHIARTYFGNGVNFGDGFVEVLAATQTPGEAGMKWFEGTADAVRKFIWVFEDAKNKNIENILILSGDHLYRMDYMDLVQNHIDRKADITVSCVPVGESRASDYGLLKMDNRGRIIQFAEKPKGADLKAMKVDTTRLGLSPQEAMKSPYIASMGVYVFKTDILLNLLRWRYPTSNDFGSEIIPLAVMEHNVEAFLFRDYWEDIGTIKTFYEANMGLTEEFPKFEFYNPKTPIFTSPRFLPPTKIEQCQVVDAIISHGCFLRECSVKHSIVGERSRLDYGVELKDTLMMGADFYQTESEIASLLAEGNVPIGIGRNTKIRNCIIDKNAKIGKDAVIVNKDGVQEADRPDDGFYIRSGITIILEKATIKDGTVI

SEQ ID NO: 163 - protein, 517 aa, Ipomoea batatas
  DOMAIN (1)...(517): AGPase (large subunit)
MEFCPTLKSSAHLPRETEFFGGRIRGSLNNNVLASKSRKSLRVDGNKRKIKPGVAFSVLTRENGTETLTVEAPILERRRANPKNVAAIILGGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 164 - protein, 527 aa, Populus trichocarpa
  DOMAIN (1)...(527): AGPase (large subunit)
MDSCCATLKANTHVAKASKGGFNNGDKEFWGERIRGSFNNSVWVNQLAKSLKVDKSVNKFKPGVAFSVLTSSNGRETVTLQPPRFERRKADPKNVASIILGGGAGTQLFPLTRRAATPAVPLGGCYRLIDIPMSNCINSGINKIFVLTQFNSTSLNRHLARTYFGNGIIFGDGFVEVLAATQTPGEAGMKWFQGTADAVRQFTWVFEDAKNRNIENILVLSGDHLYRMDYMDFVQHHIDSNADFTISCAAVGESRASDYGLVKIDGRGQVFQFAEKPKGSELREMRVDTTRLGLSPQDAMKSPYIASMGVYVFKTDILLKLLRWRYPTANDFGSEIIPAAVMEHNVQAYIFKDYWEDIGTIKSFYEANLALAEEPPKFEFYDPKTPFYTSPRFSPPTKFDKCRIVNAIISHGCFLRECTVQHSVVGERSRLDYGVELKDTVMLGADCYQTEVEIASLLAEGEVPIGVGRNTKIRNCIIDKNAKIGKDVIIMNKDGVQEADREEEGFYIRSGITIISEKATIEDGTVI

SEQ ID NO: 165 - protein, 522 aa, Coffea canephora
  DOMAIN (1)...(522): AGPase (large subunit)
MDTGFATMKATAHLATVNGENGIWGERVKGSLNGNFWVNQLAKSLKLDYEKKQKFKPGAAFSVITRETGKETLTIEAPRFERRRADPKNVAAIILGGGAGTQLFPLTSRTATPAVPVGGCYRLIDIPMSNCINSGINKIFVLTQFNSASLNRHIARTYHGNGVNFGDGFVEVLAATQTSGEAGMKWFQGTADAVRQFLWMFEDARNKDIDNILILSGDQLYRMDYMDFVQNHVDRNADITLSCVPVGESRASEFGLVKIDSRGKVVQFSEKPKGSDLKAMHVDTTILGLSPQEAFKSPYIASMGVYVFKTEVLLQLLKWRYPTSNDFGSEIIPSVVKERNVRAYIFRDYWEDIGTIKSFYDSNLALTDESAKFQFYDPKTPFFTSPRFLPPTKIDKCQIMDSIISHGCFLRECTVEHSIVGERSRLDYGVELKDTFMMGADYYQTESEIASLLAEGKVPIGIGQNTKIRNCIIDKNAKIGKDVAILNKDGVQEADRPEEGFYIRAGITVILEKATINDRTVI

SEQ ID NO: 166 - protein, 527 aa, Jatropha curcas
  DOMAIN (1)...(527): AGPase (large subunit)
MDSCCVPLKANTHMAQASRAGFRSGDKEILGENMRGSLNKGVWLNQLTRSLRVERNVNKAKPGVAYAVLTSNNPKEVVTLQPPIFERRKVDPKNVASIILGGGAGTQLFPLTRRAATPAVPVGGCYKLIDIPMSNCINSGIHKIFVLTQFNSASLNRHLARTYFGNGVNFGDGFVEVLAATQTPGEAGMKWFQGTADAVRQFVWVFEDVKNRNVENILILSGDHLYRMDYLDLLQHHVDSNADITISCAAVSESRASDYGLVKLDSRGQIIDFAEKPRGAELKSMQTDTTRVGLSPQDALESPYIASMGVYVFRTEILLKLLRWRYPTSNDFGSEIIPAAVAEHNVQAYIFKDYWEDIGTIKSFYEANLALAEEPPKFEFYDPKTPFYTSPRFLPPTKMDKCRIVDAIISHGCFLRECTIQHSVVGERSRLDYGVELKDTVMLGADYYQTEAEIASLLADGKVPIGVGRNTKIKNCIIDKNAKIGKDVVIMNKDGVQEADRPEEGFYIRSGITIIAEKATIEDGIVI

SEQ ID NO: 167 - protein, 527 aa, Citrus sinensis
  DOMAIN (1)...(527): AGPase (large subunit)
MDSCCVGLRANTHVVKASKYGSKIGDNALWGERIRGSVSNDGCTKQLKKSLKAEKRDEKVKPGVAYAVMTSKHPNEVMTLAPPRLERRRVDPKNVAAIILGGGAGTKLFPLTLRAATPAVPVAGCYRLIDIPMSNCINSGINKIFVLTQFNSASLNRHIARTYFGNGTNFGDGFVEVLAATQTPGESGKNWFQGTADAVRQFTWVFEDAKNRNIENVAILCGDHLYRMDYMDFIQSHVDRDADITISCAAVGESRASDYGLVKIDNMGRIAQFAEKPSGANLKAMQVDTSLLGFSPQEARKCPYVASMGVYVFKKDVLLKLLRWRYPTSNDFGSEIIPAAIMEHDVQAYIFRDYWEDIGTIKSFYEANMALTKESPAFHFYDPKTPFYTSPRFLPPTKIDNCRMKDAIISHGCFLRECTVEHSIVGERSRIDYGVELKDTVMLGADYYQTESEIASLLAEGKVPIGVGRNTKIRNCIIDKNVKIGKDVVIVNKDGVQEADRPELGFYIRSGITIIMEKATIEDGMVI

SEQ ID NO: 168 - protein, 524 aa, Actinidia deliciosa
  DOMAIN (1)...(524): AGPase (large subunit)
MDTFCGALGPKTHLGKVRKDCLNDGESGFWRERMRESMKNNLRVDQLGKSLRSERRARKIRPGVSCSVITTDHGKETLTIQAPRFERRRANPKNVIAIILGGGAGTQLFPLTSKTATPAVPVGGCYRLIDIPMSNCINSGINKIFVLTQFNSASLNRHIARTYGMSFGDGFVEVLAATQTPGEAGMKWFQGTADAVRQFTWVFEDAKNKDVEDILILSGDHLYRMDYMDFLQNHIDRNSDITVSCVPVGDSRASDYGLMKIDRNGQIIKFTEKPKGADLKAMEADTTRLGLSPQDAAQSPYIASMGVYVFKTDILLKLLRWRYPTSNDFGSEIIPSAVMEHNVQAYVFRDYWEDIGTIKSFYDANLALAEECPKFSFYDPKTPFFTSPRFLPPTKIDRCKIKDSIISHGCFLRECSVEHSIVGERSRLDYGVELKDTLMMGADYYQTESEIASLLAEGNIPIGVGKNTKIRNCIIDKNAKIGKGVVIVNKDGVEEADQPDQGFYIRSGITIILEKATITDGTVI

SEQ ID NO: 169 - protein, 524 aa, Prunus persica
  DOMAIN (1)...(524): AGPase (large subunit)
MDSCCVTLKPNTHLRKPSGLCNGDAGFWGERVRGSLNNKLWDNQLTKALRAEKRAKKVKSGVVLSVLTSSNTEAVAVQMPPIYRRRVDPKTVASIILGGGAGTQLFPLTIRSATPAVPVGGCYRLIDIPMSNCINSNINKIFVLTQFNSASLNRHIARTYFGNGINFGEGFVEVLAATQTPGEAGMNWFQGTADAVRQFIWVFEDAKNRDVENVLILCGDHLYRMDYTDFVQSHVDRNADITISCAAVGDSRASDYGLVKIDSRGKVIQFTEKPRGADLKAMQTDTTLLGLSPQDAMKSPYVASMGVYVFKTEILLNLLRWRYPTSNDFGSEIIPAAVREHKVQAYMFREYWEDIGTIKSFYDANLALTEEFSKFQFYDPKTPIFTSPRFLPPTKIDKCRIVDAIISHGCFLRECSVQHSIVGERSRLDYGVELKDAIMMGADYYQTETEIASLLAEGKVPVGIGRNTKIRNCIIDKNAKIGKDAVIVNKDGVREADRPEEGFYIREGITIILEKATIQDGMVI

SEQ ID NO: 170 - protein, 547 aa, Gossypium raimondii
  DOMAIN (1)...(547): AGPase (large subunit)
MKSRNQRLQFRVLNGEKALMDSCCVALKVNSHLVNVRNSGFGNGDNAFLGERIRGSLNNNSVWVNRVANSLSTYNKKAMKIKPGAFAVITSNNPREAKALPSRRFNRQRVDPKNVASIILGGGAGTHLFPLTRRAATPAVPIGGCYKLIDIPMSNCINSGINKIFVLTQFNSASLNRHVARTYYGNGINFGDGFVEILAATQTSGEAGKKWFQGTADAVRQFIWVFEDAKNRNIENVVILCGDHLYRMDYMEFVQSHVDGNADITISCVTMDNSRASDYGLVKIDGRGRIVQFSEKPKGADLKAMQTDTTLLGLSPQEAASCPYIASMGVYVFKTDVLLKLLRWRFPTSNDFGSEIIPAAVKEHDVQAYIFKDYWEDIGTIKSFYEANLALTEEFPKFEFYDPKTPFYTSPRYLPPTKIDKCRIKDAIISHGCFLRECSVQHSVIGERSRLDSGVELQDTVMMGADYYQTELEIISLLAEGKVPIGIGHNTKISNCIIDKNAKIGRDVIIANKDGVQEADRSDEGFYIRSGITIILDKATIKDGTII

SEQ ID NO: 171 - protein, 527 aa, Hevea brasiliensis
  DOMAIN (1)...(527): AGPase (large subunit)
MDSCSVAVKANAHVAKPSKGDFKSGDKEFWGERIRGSLNNSIWSHQMTRSLRAERNVIKVKPGVACAVLTSNNPKEVVTLQPPRFERRKVDPKNVASIILGGGAGTALFPLTRRAATPAVPVGGCYKLIDIPMSNSINSGINKIFVLTQFNSASLNRHIARTYFGNGINFGDGFVEVLAATQTPGEAGMRWFQGTADAVRQFTWVFEDAKNRNVENIVILSGDHLYRMDYMDFVQHHVDSNADITISCAAVSESRASDYGLVKIDNRGRIVHFAEKPSGAELKSMRADTTHLGLSLQDALKSPYIASMGVYVFRTEILLKLLRWRYPTPNDFGSEIIPAAVMEHNVQAHIFRDYWEDIGTIKTFYEENLALTEESPKFEFYDPKTPFYTSPRFLPPTKIDKCRIVDAIISHGCFLRECTIQHSVVGERSRLDYGVELKDTVMLGADCYQTEAEIASLLAEGEVPIGVGRDTKIKKCIIDKNAKMGKNVVITNKDGVQEADRPEEGFYIRSGITIISEKATIEDGTVI

SEQ ID NO: 172 - protein, 527 aa, Eucalyptus grandis
  DOMAIN (1)...(527): AGPase (large subunit)
MDSRCVALKANASLAQSNKSCLKNVDKGFLGERIRGSLDNSVWVKQVARNLRVEKKFKKAKPGVAFAVITSNTVAETLTIRSPVLHRPRADPKKVAAIILGGGAGIQLFPLTRRAATPAVPVGGCYRLIDIPMSNCINSGINKIFVLTQFNSASLNRHLARTYFGNGVNFGDGFVEVLAATQTPGETGKKWFEGTADAVRKFIWVFEDAKNRNIEDIIILAGDHLYRMDYMDFLQNHIDRNSAISVACTPVGESRASDYGLVKIDSRGQIVQFSEKPKGPDLTAMQVDTTTLGLSPQEAARSPYIASMGVYAFKTESLLNLLKWRYPTANDFGSEIIPSAVMEQDVQAYIFRDYWEDIGTIKSFYDANLALTEEVPKFEFYDPKTPIFTSPRFLPPTKIDNCKLKDAIISHGCFLRECRVERSIVGERSRLDSGVELKDTVMMGADYYQTESEIASLLAEGKVPIGIGKNTKIRNCIIDKNAKIGKDVAIVNKDGVEEADRPGDGFYIRLGITVILEKATIEDGTVI

SEQ ID NO: 173 - protein, 526 aa, Theobroma cacao
  DOMAIN (1)...(526): AGPase (large subunit)
MDSCCVALRANSHLVNARKGGFGNGNNGFWGERIRGSLNNSLWVNQLANSLRTDKKEKKIKTGAFAVLTSNTPREAVTLQPRRIERRRVDPKNVASIILGGGTGTHLFPLTKRAATPAVPVGGCYKLIDIPMSNCINSGINKIFVLTQFNSASLNRHLARTYYGNGINFGDGFVEVLAATQTSGEAGKKWFQGTADAVRQFIWVFEDARNRNIEYILILCGDHLYRMDYMEFLQRHVDSDADITISCLTVDNSRASDYGLVKIDGRGRIVQFAEKPKGADLKAMQTDTTLLGLSPQEAMRSPYIASMGVYVFKTDVLLKLLRWRFPTSNDFGSEIIPAAVMEHDVQAYIFRDYWEDIGTIKSFYDANLALTEELPKFEFYDPKTPFYTSPRYLPPTKIDKCQIKDAIISHGCFLRECNVQHSIVGERSRLDYGVELQDTVMLGADYYQTESEIASLLAEGKVPIGIGRNTKIRTCIIDKNAKIGKDVVIVNKDDVQEADRPEEGFYIRSGITIIQEKATIEDGTVI

SEQ ID NO: 174 - protein, 518 aa, Zea mays
  DOMAIN (1)...(518): AGPase (large subunit)
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMNARVGRNVSITNKEGVQEADRPDEGYYIRSGIVVVLKNATIKDGTVI

SEQ ID NO: 175 - protein, 519 aa, Saccharum hybrid cultivar R570
  DOMAIN (1)...(519): AGPase (large subunit)
MQFSSVFPLEGKACMRPVRRGGEGSWSERMRIGNSCSIRRNKALRRMCFGARGAVSSAQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAARKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDDPTKYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLSEGKVPIGVGENTKISNCIIDMNARVGRNVSITNTEGVQEADRPEQGYYIRSGVVVILKNATIKDGTVI

SEQ ID NO: 176 - protein, 519 aa, Sorghum bicolor
  DOMAIN (1)...(519): AGPase (large subunit)
MQFSSVFPLEGKACMSPVRRGGEGAWSERVRIGNSCSIRRNKALRRMCFGARGAVSSAQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDDPTKYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLSEGKVPIGVGENTKISNCIIDMNARVGRNVSITNTEGVQEADRPELGYYIRSGIVVILKNATIKDGTVI

SEQ ID NO: 177 - protein, 518 aa, Setaria italica
  DOMAIN (1)...(518): AGPase (large subunit)
MQFSSVFPLEGKACVSPVRRGSEGSGSERMRIGDCSSIRQNRALRRMCFGARGTTSSAQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAGWFQGTADAVRKFIWVLEDYYKHKAIEHILILSGDQLYRMDYMELVQKHVDDNADITLSCAPVGESRASDYGLVKFDSSGRVIQFSEKPKGADLEEMKVDTSFLNFAIDDPSKYPYIASMGVYVFKRDVLLNLLKSRYSQLHDFGSEILPKALHEHNVQAYVFTDYWEDIGTLRSFFDANMALCEQPPKFEFYDPKTPFFTSPRYLPPTKSDKSRIKDAIISHGCFLRECTIEHSIVGVRSRLNSGCELKNTMMMGADLYETEDEISRLLSEGKVPIGVGENTKISNCIIDMNARVGRNVSITNSEGVQEADRPEEGYYIRSGIVVILKNATIKDGTVI

SEQ ID NO: 178 - protein, 519 aa, Oryza brachyantha
  DOMAIN (1)...(519): AGPase (large subunit)
MQFSSVFPLEGKACVSPIRRGGEGPGSDRLKIGDSISIKHDRAVRRMCFGARGTRNSAQCVLTSDAGPDTLHVRTSFRRNYADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGADLEAMKVDTSFLNFAIDDPTKYPYIASMGVYVFKREVLLNLLKSRYSELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSGCELKNTMMMGADLYETEDEISRLLSEGKVPIGVGENTKISNCIIDMNARVGRNVVIKNSEGVQEADRPEEGYYIRSGIVVILKNATIKDGTVI

SEQ ID NO: 179 - protein, 522 aa, Brachypodium distachyon
  DOMAIN (1)...(522): AGPase (large subunit)
MSRMQFSSVLPLEGKACVSPLRRNVESSGSERIRIGDSSTIKHERALRRMCFGARGAASGAQCVLTSDASPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGVDLEAMKVDTSFLNFAIDDPAKFPYIASMGVYVFKRDVLLNLLKSRYAELHDFGSEILPRALHEHNVQAYVFTDYWEDIGTIRSFFDANMALCEQPPKFEFYDPKTPFFTSPRYLPPTKSDKCRIKEAIISHGCFLRECTIEHSIVGVRSRLNSGCELKNAMMMGADLYETEDEISRLLSEGKVPIGVGENAKISNCIIDMNARIGRDVIIANSEGVEEADRAEEGYYIRSGIVVILKNATIKDGTVV

SEQ ID NO: 180 - protein, 519 aa, Oryza sativa Japonica Group
  DOMAIN (1)...(519): AGPase (large subunit)
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 181 - protein, 522 aa, Triticum aestivum
  DOMAIN (1)...(522): AGPase (large subunit)
MSSMQFSSVLPLEGKACISPVRREGSASERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 182 - protein, 523 aa, Hordeum vulgare
  DOMAIN (1)...(523): AGPase (large subunit)
MSSMQFSSVLPLEGKACVSPVRREGSACERLKIGDSSSIRHERASRRMCNGGARGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 183 - protein, 503 aa, Hordeum vulgare
  DOMAIN (1)...(503): AGPase (large subunit)
MDLRVAAPASVAAAARRGALGCARVRPLQGRRQCRPSVRVSVATTESAAAAAAVSASADEDAETTNPRTVVAVILGGGAGTRLFPLTKRRAKPAVPIGGAYRLIDVPMSNCINSGINKVYVLTQFNSASLNRHLFRAYNFSNGVGFGDGFVEVLAATQRPGSEGKRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDKNARIGKNVTIANTEGVQESDRTSEGFHIRSGITVVLKNSVIADGLVI

SEQ ID NO: 184 - protein, 517 aa, Sorghum bicolor
  DOMAIN (1)...(517): AGPase (large subunit)
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 185 - protein, 518 aa, Oryza sativa
  DOMAIN (1)...(518): AGPase (large subunit)
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKDGTVI

SEQ ID NO: 186 - protein, 518 aa, Oryza sativa
  DOMAIN (1)...(518): AGPase (large subunit)
MEFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKHGPII

SEQ ID NO: 187 - protein, 516 aa, Lycopersicon esculentum
  DOMAIN (1)...(516): AGPase (large subunit)
MSVATDVRFALLRNNPAALTGTNLKIVKFCNGELMGKKLKYTKFQLRSNVVKPHICMSLTTDIAGEAKLKDLEAKKEDARTVVAIILGGGGGTRLFPLTKRRAKPAVPIGGAYRLIDVPMSNCINSGINKVYILTQFNSASLNRHIARAYNFGNGVTFGDGYVEVLAATQTPGELGKRWFQGTADAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASMGVYVFKKDILLNLLRWRFPTVNDFGSEIIPASTKEFCVKAYYLFNDYWEDIGTIRSFFEANLALTEHPPRFSFYDATKPIYTSRRNLPPSAIDNSKIVDSIVSHGSFLTNCFVEHSVVGIRSRIGTNVHLKDTVMLGADYYETDAEIASQLAEGKVPLGIGENTRIKECIIDKNARIGKNVVIANSEGVQEADRSSEGFYIRSGITVILKNSTIPDGTVI

SEQ ID NO: 188 - protein, 518 aa, Lycopersicon esculentum
  DOMAIN (1)...(518): AGPase (large subunit)
MDALCAGTAQSVAICNQESTFWGQKISGRRLINKGFGVRWCKSFTTQQRGRGVTSAVLTRDINKEMLPFENSMFEEQPTADPKAVASVILGGGVGTRLFPLTSRRAKPAVPIGGCYRLIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFAEKPKGPALKVMQVDTSILGLSEQEASNFPYIASMGVYVFKTDVLLKLLKSAYPSCNDFGSEIIPSAVKDHNVQAYLFNDYWEDIGTVKSFFDANLALTKQPPKFDFNDPKTPFYTSARFLPPTKVDKSRIVDAIISHGGFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 189 - protein, 519 aa, Solanum tuberosum
  DOMAIN (1)...(519): AGPase (large subunit)
MDALCASMKGTAQLVAICNQESAFWGEKISGRRLINKGFGVRSCKSFTTQQRGRNVTPAVLTRDINKEMLPFEESMFEEQPTADPKAVASVILGGGVGTRLFPLTSRRAKPAVPIGGCYRLIDVPMSNCINSGIRKIFILTQFNSFSLNRHLATYNFGNGVGFGDGFVEVLAGTQTPGDGRKMWFQAADAVREFIWVFENQKNKNVEHIIILSGDHLYRMNYMDFVQKHIDTNADITVSCVPMDDGRASDFGLMKIDETGAIIQFAEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTECEIASLLAEGKVPIGVGPNTKIQNCIIDKNAKIGKDVVILNKEGVEEADRSAEGFYIRSGITVIMKNATIKDGTVI

SEQ ID NO: 190 - protein, 515 aa, Ipomoea batatas
  DOMAIN (1)...(515): AGPase (large subunit)
MDAYCATLKSTTHLPRESELWGKRMLKTSVVVNQFGKSLKLERNGRKIKPGVAFSVLTRETGRETLSVEAPRLERVRANPKNVAAIILGGGAGTQLFPLTNRAATPAVPVGGCYRMIDIPMSNCINSGINKIFVLTQFNSASLNRHIARTYFGNGVSFGDGFVEVLAATQTSGETGMKWFQGPADAVRKFTWVFEDAKNKDIENILILSGDQLYRMDYMDLVQNHLDRNSDITLSCAPVGDSRAVDFGLVKIDRRGKVVQFQEKPKGADLEAMQVDTTRLGLSPEDAKRNPYIASMGLYVFRRDLLLNLLRWIYPTANDFGSEIIPAVITEHNVQAYFFKDYWEDIGTIKTFYDANLALAEEFPKFEFYDPKTPFYTSPRFLPPTKIDNCKIKDAIISHGCFLRECIVEHSIVGERSRLDFGVELKDTLMMGADYYETESEIASLLADGKVPIGIGHNTKISNCIIDKNVRIGKDVIIANKDGVEEADRPEEGFYIRSGIPVIMEKAVIKDGTVI

SEQ ID NO: 191 - protein, 525 aa, Ipomoea batatas
  DOMAIN (1)...(525): AGPase (large subunit)
MAVTADGRIALLAARQLREGAAMTVSSCRLSVKFCNGEFMGKKIKLRKFQQRNGTKYNVVARPRVSMSLTTDVAGEAKLKDYGMEKTDPRTVVAIILGGGAGTRLFPLTKRRAKPAVPIGGAYRLIDVPMSNCINSGINKVYILTQFNSASLNRHLARAYNFGSGVTFGDGYVEVLAATQTPGEAGKRWFQGTADAVRQFHWLFEDPKSKDIEDVLILSGDHLYRMDYMDFVQSHRQSGADITISSLPIDDRRASDFGLMKIDDKGRVLFFSEKPKGDDLKAMAVDTSVLGLSPEEAKQKPYIASMGVYVFKKEILLNLLRWRFPTANDFGSEIIPASAREFYIQAYLFNDYWEDIGTIRSFFEANLALTEHPPRFSFYDATKPIYTSRRNLPPSAITNSKIVDSIISHGSFLSDCFVEHSVVGIRSRINSNVHLKDTVMLGADYYETGAEIASLLTEGGVPIGIGENSRIKECIIDKNARIGKNVVIANSEGIQEADRTSEGFYIRSGVTVILKNSTIPDGLVI

SEQ ID NO: 192 - protein, 510 aa, Pisum sativum
  DOMAIN (1)...(510): AGPase (large subunit)
MASGCVSLKTNTHFPNSKKGSFFGERIKGSLKNSSWVTTQKKIKPASFSAILTSDDPKGSLNLQVPSFLRLRADPKNVISIVLGGGPGTHLYPLTKRAATPAVPVGGCYRLIDIPMSNCINSGINKIFVLTQFNSASLNRHIARTYFGNGVNFGDGFVEVLAATQTPGEAGKKWFQGTADAVRQFTWIFEDAKNINVENVLILAGDHLYRMDYMDLLQSHVDRNADITVSCAAVGDNRASDYGLVKVDDRGNIIQFSEKPKGADLKAMQVDTSRLGLSPQDALKSPYIASMGVYVFKKDVLLKLLKWRYPTSNDFGSEIIPSAIREHNVQAYFFGDYWEDIGTIKSFYDANLALTEESPKFEFYDPKTPIFTSPGFLPPTKIDNSRVVDAIISHGCFLRDCTIQHSIVGERSRLDYGVELQDTVMMGADYYQTESEIASLLAEGKVPIGIGRNTKIKNCIIDKNAKIGKEVVIANKEGVQEADRSEDGFYIRSGITIIMEKATIEDGTVI

SEQ ID NO: 193 - protein, 507 aa, Fragaria x ananassa
  DOMAIN (1)...(507): AGPase (large subunit)
MDSWCVTLKPNTHLRQPTQAGLCCGANGFLGQRIRESFGNRGWVHGSEKTRPGVVSSVVTTKDFETTLKVPTYHRPRVDPKNVASIILGGGAFTQLFPLTRRAATPAVPVGGCYRLIDIPMSNCINSNINKIFVLTQFNSTSLNRHLARTYFGNGINFGDGFVEVLAATQTSGEAGMDWFQGTADAVRQFVWVFEDAKNRNVENILILSGDHLYRMDYMDFVQSHVDSNADITLSCAVVGDSRASDYGLVKIDSRGKIIQFAEKPRGAGLKAMQSDTTLLGFSPQDALKSPYVASMGVYVFKTDILLELLKKSYPNSNDFGSEIIPAAVEERNVQAYIFIDYWEDIGTIQSFYDANLALTEEFPKFQFYDPKTPFFTSPRFLPPTKIDNSRVVDAIISHGCFLQECFVQSSIVGERSRLDYGVELKDSIMMGADSYQTESEIAALLARGKVPIGIGRNTKIRLCIVDLNAKIGKDVIIMNKDGIQEADRPEEGFYIREESLSLWRRE

SEQ ID NO: 194 - protein, 522 aa, Beta vulgaris
  DOMAIN (1)...(522): AGPase (large subunit)
MDASAAAINVNAHLTEVGKKRFLGERISQSLKGKDLRALFSRTESKGRNVNKPGVAFSVLTSDFNQSVKESLKYEPALFESPKADPKNVAAIVLGGGAGTRLFPLTSRRAKPAVPIGGCYRLIDVPMSNCINSGIRKIFILTQFNSFSLNRHLARTYNFGDGVNFGDGFVEVFAATQTPGESGKKWFQGTADAVRQFFWAFEDSKSKDVEHIVILSGDHLYRMDYMSFWQKHIDTNADITVSCIPMDDSRASDYGLMKIDHTGRIVHFAEKPKGSDLTAMQVDTTVLGLSDLEAMSNPYIASMGVYVFRTDVLMELLNRKYPSSNDFGSEIIPSAVGESNVQAYLFNDYWEDIGTIKSFFDSNLALTQQPPKFEFYDPKTPFYTSARFLPPTKVDRCKIVDSIVSHGCFLQESSIQHSIVGVRSRLESGVEFQDTMMMGADYYQTESEIASLLAEGKVPVGVGQNTKIKNCIIDKNAKIGKDVVIANTDGVEEADRPNEGFYIRSGITIILKNATIQDGLVI

SEQ ID NO: 195 - protein, 521 aa, Cicer arietinum
  DOMAIN (1)...(521): AGPase (large subunit)
MDLAIGSNYASLRSSVFLGETLKGNLSTKFLTSPKFSQIHINNLRSFNPRNGASYSVLTSGINDFEESMTFHEGPYFDTPKADPKSVASIILGGGAGTRLFPLTSKRAKPAVPIGGCYRLIDIPMSNCINSGIRKIFILTQFNSFSLNRHLSRSYNFGNVSTFGEGFVEVLAATQTSGEAGKKWFQGTADAVRQFIWVFEDAKTKNVEHILILSGDHLYRMNYMDFVQKHIDTNADITVSCIPMDDSRASDYGLLKIDGKGRIIQFAEKPKGSELKAMRVDTTLLGLSPEEAKKQPYIASMGVYVFRTETLLKLLRSNCSTCNDFGSEIIPSAVNDDHNVQAYLFNDYWEDIGTIKSFFDANLALTDQPPKFQFYDPNTPFYTFPRFLPPTKVEKCKIVDAIISHGCFLRECSVQHSIVGIRSRLESGVELQDTMMMGADYYQTESEIASLLAEGKVPVGVGENTKIRNCIIDKNARIGRNVIITNADGVEEADRTKEGFYIRSGITAILKNATIKDGTVI

SEQ ID NO: 196 - protein, 481 aa, Citrullus lanatus
  DOMAIN (1)...(481): AGPase (large subunit)
NSNSSPRSTARKLTPGVAYSVLMSEISEVSSTLQAPIFETPRADPKKIASIILGGGAGTRLFPLTSQRAKPAVPIGGCYRLIDIPMSNCINSGIEKIFVLTQFNSFSLNRHLARIYNFGNGVNFGDGFVEVLAATQTSGETGKKWFQGTADAVRQFIWLFEDAKTKNVEHTLILSGDHLYRMDYMDFVQRHIDTNADITVSCIPMDDSRASDYGLMKIDDTGRILHFAEKPKGSDLEAMKVDTTVLGLSNQDARKNPYIASMGVYIFRTDLLLKLLTWSYPSCNDFGSEIIPSAVKDYKVQAYLFNDYWEDIGTVKSFFDANLALTEQPPKFEFYDPKTPFYTSPRFLPPSKVEKCRIVDAIISHGCFLRECSVEHSIVGVRSRLEYGVELKDTMMMGADYYQTESEIASLLAEGKIPIGIGENTKIRNCIIDKNARIGRNVVIANSDDVQEADRPEDGFYIRSGITVTLKNATIKDGTII

SEQ ID NO: 197 - protein, 526 aa, Citrullus lanatus
  DOMAIN (1)...(526): AGPase (large subunit)
MVAMDSCFVSLKSNTHLMKGNWGGLDRCENGFYGEKVRGSFNENAWIKSLKSEKKALKLTPNVAYAVATPNISKQPVSIQVPSIPKVKANPKNVASIILGGGAGTHLFPLTRRSATPAVPVGGCYRLIDIPMSNCINSGINKIFVLTQFNSASLNRHISRTYFGNGVNFGEGFVEVLAATQTSGETGMHWFQGTADAVRQFIWVFEDAKNRNVENILILAGDHMYRMDYMDFVQNHIDRNADISISCAAVGDSRASDYGLVKIDSRGRIIQFSEKPMGANLSAMRVDTTSFGLSREESLKSPYIASMGVYVFKTDILLNLLKWRYPTSNDFGSEIIPAAVKEHNVQAYIFRDYWEDIGSIKTFYDANLALTEEFPKFEFYDPKTPIYTSPRFLPPTKIDKCQIVDAIISHGCFLRECSVQHSIVGERSRLDYGVELKDTIMMGADTYQTEPEIAGLLAEGKVPIGIGRNTKIRNCIIDKNAKIGKDVVIMNKEGVQEADRPEQGFYIRSGITIILEKATIEDGTVI

SEQ ID NO: 198 - protein, 525 aa, Cucumis melo
  DOMAIN (1)...(525): AGPase (large subunit)
MVAMDSCFVSLKSNTQLMKGNWGGLDRCENGFMVEKVRGGFNENVWIKSLKYEKKALKLTPNVAYAVTPNVSKQPMTIQVPTVPKVKANPKNVASIILGGGAGTHLFPLTKRSATPAVPAGGCYRLIDIPMSNCINSGINKIFVLTQFNSASLNRHISRTYFGNGVTFKEGFVEVLAATQTSGESGMYWFQGTADAVRQFIWVFEDAKNRNVENILILAGDHMYRMGYMDFVQNHIDRNADISISCAAVDDSRASDYGLVKLDSRGRIIQFSEKPKGANLNRMRVDTTSFGLSREESLKSPYIGSMGVYVFKTDVLLNLLKWRYPSSNDFGSEIIPAAIKDHNVQAFMFRDYWEDIGTIKTFYDANLALHGNVSKFEFYDPKTPFYTSPRFLPPTKIDRCQIVDAIISHGCFLRECSIQHSIVGERSRLDYGVELKDTIMMGADNYQTESEITGLLAEGKVPVGIGPNTKIRKCIIDKNAKIGKDVIIMNKDGVQEADRPEQGFYIRSGITIVMEKATIEDGTVI

SEQ ID NO: 199 - protein, 518 aa, Cucumis melo
  DOMAIN (1)...(518): AGPase (large subunit)
MHKISSQEKNQCFGFWGDSSLGRNGRWKQIQRNASSRNNSDSSSSSRARSLHPELLILFSCSEVNEETTTLQAPIFEAPRADPKKVASIILGGGAGTRLFPLTSQRAKPAVPIGGCYRLIDIPMSNCINSGIEKISSNAVNSFSLNRHLARIYNFGNGVNFGDGFVEVLAATQTSGETGKKWFQGTADAVRPFIWLFEDAQTKNVEHTLILSGDHLYRMDYMDFVQRHIDTNADITVSCIPMDDSRASDYGLMKIDDTGRIIHFSEKPKGSDLEEMQVDTAVLGLSDEDARKNPYIASMGVYIFRTDLLLKLLTWSYPACNDFGSEIIPAAVKDYKVQAYLFNDYWEDIGTVKSFFDANLALTEQPPKFEFYDPKTPFYTSPRSCPPSKVEKCRIVDAIISHGCFLRECTVEPLIVGVRSRLEYGVELKDTMMMGAYYYQTESEIASLLAEGKIPIGIGENTKIRNCIIDKNAKIGRNVVIANTDDVQEADRPEEGFYIRSGITVTLKNATIKDGTII

SEQ ID NO: 200 - protein, 451 aa, Solanum tuberosum
  DOMAIN (1)...(451): AGPase (small subunit)
MAVSDSQNSQTCLDPDASRSVLGIILGGGAGTRLYPLTKKRAKPAVPFGANYRLIDIPISNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSLYDRSAPIYTQPRCLPPSKMLDADVTDSVIGEGCVIKNCKIHHSVVGLRSCISEGAIIEDSLLMGADYYETDADRKSLAAKGSVPIGIGKNCHIKRAIIDKNARIGDNVKIINKDNVQEAARETDGYFIKSGIVTVIKDALIPSGIII

SEQ ID NO: 201 - protein, 521 aa, Solanum lycopersicum var. cerasiforme
  DOMAIN (1)...(521): AGPase (small subunit)
MAASIGALKSSPSSHNCINERRNDSTRAISSRNLSFSSSHLAGDKLMPVSSLRSQGVRFNVRRSPLIVSPKAVSDSQNSQTCLDPDASRSVLGIILGGGAGTRLYPLTKKRAKPAVPLGANYRLIDIPVSNCLNSNISKIYVLTRFNSASLNRHLSRAYASNMGGYKNEGFVEVLAAQQSPENPDWFQGTADAVRQYLWLFEEHNVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 202 - protein, 520 aa, Nicotiana sylvestris
  DOMAIN (1)...(520): AGPase (small subunit)
MASIGALKSSPSPKNCINERRNDATRAMSFRNLSFSSSHLSGDKLMSMATLHSQQRHSSERRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVKIINSDNVQEAARETDGYFIKSGIVTVIKDALIPSGIII

SEQ ID NO: 203 - protein, 520 aa, Nicotiana tomentosiformis
  DOMAIN (1)...(520): AGPase (small subunit)
MASVGALKSSPSPQNCINEKRNDATRAMSFRNLSFSSSHLSGDKLMSMATLHSQQRHSSERRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVKIINSDNVQEAARETDGYFIKSGIVTVIKDALIPSGIII

SEQ ID NO: 204 - protein, 520 aa, Nicotiana tabacum
  DOMAIN (1)...(520): AGPase (small subunit)
MASIGALKSSPSPKNCINERRNDATRAMSFRNLSFSSSHIYGDKLMSMATLHSQQRHSSERRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVKIINSDNVQEAARETDGYFIKSGIVTVIKDALIPSGIII

SEQ ID NO: 205 - protein, 523 aa, Perilla frutescens
  DOMAIN (1)...(523): AGPase (small subunit)
MAATAVFKSTPGKTAIANYSSLEDVNSTSFKRLSFAASNVAGERITSPPRLRVRRSRAGGELERRSPVIVSPKAVSDSQNSQTCLDPDASRSVLGIILGSGAGTKLYPLTKKRAKPAVPFGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEKRPTAFGLMKIDEEGRIIEFAEKPKGEQLKAMKVDTTILGLDDKRAKEMPYIASMGIYVVSKDVMLNLLRDEFPAANDFGSEVIPGATAMGLRVQAYLFDGYWEDIGTIEAFYNANLGITKKPVPDFSFYDRSAPIYTQPRYLPPSKMLDADVTDSVIGEGCVIKNCKIHHSVVGLRSCIAEGAIIEDTLLMGADYYETDADRRFLAAKGGVPIGIGKNTHIKRAIIDKNARIGENVKIVNGDNVQEAARETDGYFIKSGIVTVIKDALIPSGTMI

SEQ ID NO: 206 - protein, 505 aa, Actinidia chinensis
  DOMAIN (1)...(505): AGPase (small subunit)
MAAIGVLKVPHRTANVTGERATLRSTPFRRLSLAGGKISPKLASPRRRSATFSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDERAKEMPYIASMGIYVVSKDVMLNLLRDKFPGANDFGSEVIPGATSIGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDDVKIINSDNIQEAARETDGYFIKSGIVTVIKDALIPSGTVI

SEQ ID NO: 207 - protein, 578 aa, Citrus clementina
  DOMAIN (1)...(578): AGPase (small subunit)
MTKLFIYHDHDRDHTETWLHIRSSSAFFSLQLTLSLAHTHSGSARLTITVNVNRLYRLMASMASIGSLKVPSSPSTAATSSNSNNHSRRSVVKRLAFSSSQLSGDKIFSKAVTGDRRRERRPIVVSPQAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFSEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPIPDFSFYDRSAPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKNARIGDNVKIVNSDSVQEAARETDGYFIKSGIVTIIKDALIPSGTII

SEQ ID NO: 208 - protein, 523 aa, Ipomoea batatas
  DOMAIN (1)...(523): AGPase (small subunit)
MAAAIGAPKLAPYTCAAERNDGSARRAARFKSLSFASSNLSGDKLASLVSRRCSRSGGKSSERRNAPIIVSPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRLLAAKGSIPIGIGRNSHIKRAIIDKNARIGDNVKIINSDDVQEAARETDGYFIKSGIVTVIKDALIPSGTVI

SEQ ID NO: 209 - protein, 520 aa, Gossypium raimondii
  DOMAIN (1)...(520): AGPase (small subunit)
MAATAALRLITTTKSSSSSNAASISPSSGIFLAPRTLSFSASALSGDKLVSKTVTSSRQMKRTPFIISPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGDQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKNARIGDNVKIINSDNVQETARETDGYFIKSGIVTVIKDALIPSGTVI

SEQ ID NO: 210 - protein, 520 aa, Citrus sinensis
  DOMAIN (1)...(520): AGPase (small subunit)
MASMASIGSLKVPSSPSTATTSSNSNNHSRRSVVKRLAFSSSQLSGDKIFSKAVTGDRRSERRPIVVSPQAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFSEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPIPDFSFYDRSAPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKDARIGDNVKIVNSDSVQEAARETDGYFIKSGIVTIIKDALIPSGTII

SEQ ID NO: 211 - protein, 509 aa, Vitis vinifera
  DOMAIN (1)...(509): AGPase (small subunit)
MASLSALGVTGVVPTSSKSRDLPSSHRTLSFSSRISGNKITWKASLGSHRRAPVIVSPKAVSDSRNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDERAKEMPYIASMGIYVVSKDVMLDLLRDQFPGANDFGSEVIPGATSLGLRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETDADRRFLMAKGSVPIGIGKNSHIKRAIIDKNARIGDNVKIINSDNVQEAARETDGYFIKSGIVTVIKDALLPSGTII

SEQ ID NO: 212 - protein, 510 aa, Beta vulgaris subsp. vulgaris
  DOMAIN (1)...(510): AGPase (small subunit)
MAGMAVIGGITVPSTSSKNLQNSLAFSSSSLSGDKIQTTSFLNRRYCRISSRAPIVVSPKAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYERFVQAHRETDADITVAALPMDEKRATAFGLMKIDEEGRIIEFAEKPKGEQLKAMKVDTTILGLDDERAKEMPFIASMGIYVISKDVMLNLLREQFPGANDFGSEVIPGATSIGLRVQAYLYDGYWEDIGTIEAFYNANLGITKKPVPDFSFYDRSSPIYTQPRYLPPSKMLDADITDSVIGEGCVIKNCKIHHSVIGLRSCISEGAIIEDTLLMGADYYETDADRKFLAAKGSVPIGIGKNAHIKRAIIDKNARIGDDVKIINSDNVQEAARETDGYFIKSGIVTIIKDALIPSGTVI

SEQ ID NO: 213 - protein, 520 aa, Brassica napus
  DOMAIN (1)...(520): AGPase (small subunit)
MATMAAIGSLKVPSSSSNHTRRLSSSSQRKTLSFSSSSLAGEKINPTQEIIISNLPGRNERRRPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 214 - protein, 536 aa, Eucalyptus grandis
  DOMAIN (1)...(536): AGPase (small subunit)
MASMAAVGAIRVPTSSSSSSSSSSSSFPAASESRHQRRWCNGHGRSSSALSFASSQVAGDKIASSAAASAAAFKSVRRAPAVVSPRAVSDSRNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHDVLEFLILAGDHLYRMDYERFIQAHRETDADITVAALPMDEKRATAFGLMKIDEEGRIIEFAEKPKGEQLKAMKVDTTILGLDDERAKEMPYIASMGIYVISKDVMLNLLRDKFPGANDFGSEVIPGATSVGMRVQAYLYDGYWEDIGTIEAFYNANLGITKKPVPDFSFYDRSSPIYTQPRYLPPSKMLDADVTDSVIGEGCVIKNCKIHHSVIGLRSCISEGAIIEDTLLMGADYYETDADRRFLAAKGSVPIGIGKNSHIKRAIIDKNARIGENVKIINSDDVQEAARETDGYFIKSGIVTVIKDALLPSGTVI

SEQ ID NO: 215 - protein, 526 aa, Cucumis melo
  DOMAIN (1)...(526): AGPase (small subunit)
MASSMAAVGVLRLPTSSSSSSSSSNGGSNRARRTSLRSLSFGASQISGDKIDFRGFGLGSRRVSGGRVAPSIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGENVKIVNGDNVQEAARETDGYFIKSGIVTVIKDALIPSGTII

SEQ ID NO: 216 - protein, 521 aa, Ricinus communis
  DOMAIN (1)...(521): AGPase (small subunit)
MASMAAIGVLKVPSASSSSFSNSSNCSRRLGNLSFSSSVNVSGDKIYCSKSSSFSGHYNYNGRTPMIVSPKAVSDSRNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEKRATAFGLMKIDEEGRIIEFAEKPKGEQLKAMKVDTTILGLDDERAKEMPYIASMGIYVVSKNVMLDLLRDKFPGANDFGSEVIPGATSIGLRVQAYLYDGYWEDIGTIEAFYNANLGITKKPIPDFSFYDRSSPIYTQPRYLPPSKMLDADVTDSVIGEGCVIKNCKIHHSVVGLRSCISEGAIIEDTLLMGADYYETDADRRFLAAKGSVPIGIGRNSHIKRAIIDKNARIGDNVKIINSDNVQEAARETDGYFIKSGIVTVIKDALIPSGTVI

SEQ ID NO: 217 - protein, 520 aa, Brassica rapa
  DOMAIN (1)...(520): AGPase (small subunit)
MATMAAIGSLKVPSSSSNHTRRLSSSSQRKTLSFSSSSLTGEKLNPTQEIIISNLPRGNERRTPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 218 - protein, 522 aa, Populus trichocarpa
  DOMAIN (1)...(522): AGPase (small subunit)
MASMAAIGVMRPPSSSSLSSSSSSNLSRRTAFRSLSFSSSSNLSGGKVCSTAFSVRRDTGRNERTPMIVSPKAVSDSRNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVIGLRSCISEGAIIEDTLLMGADYYETDADRRFLAAKGSVPIGIGKNSHIKRAIIDKNARIGDNVKIINGDNVQEAARETDGYFIKSGIVTVIKDALIPSGTVI

SEQ ID NO: 219 - protein, 523 aa, Jatropha curcas
  DOMAIN (1)...(523): AGPase (small subunit)
MMASAAAIGALKVPLPASSSTNSSKLNRKTSPLVQSLSFSSSNLSGDKIYYKAFSGRPGNGSNERTPMVVSPKAVSDSKNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEARATAFGLMKIDEEGRIVEFAEKPKGEQLKAMKVDTTILGLDDERAKEMPYIASMGIYVVSKNAMLDLLRDRFPGANDFGSEVIPGATSIGMRVQAYLYDGYWEDIGTIEAFYNANLGITKKPIPDFSFYDRSSPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKNARIGDNVKIINSDNVQEAARETDGYFIKSGIVTVIKDALIPSGTVI

SEQ ID NO: 220 - protein, 515 aa, Glycine soja
  DOMAIN (1)...(515): AGPase (small subunit)
MASMAAIGSLNVPRSASSRSSFVGRKSVPRSLSFSASQLCGDKIPTDSVLLAPKIGRSPVIVTPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEARATAFGLMKIDEEGRIIEFAEKPKGEQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDALLMGADYYETEADKRFLAAKGSVPIGIGRNSHIKRAIIDKNARIGENVKIINSDNVQEAARETDGYFIKSGIVTVIKDALIPSGTVI

SEQ ID NO: 221 - protein, 524 aa, Prunus persica
  DOMAIN (1)...(524): AGPase (small subunit)
MASSSMAASGVLRPRSSSMFPNALKQTQNASLCRSSRGLSFSGSHLSGTKIPTASTCLRKCPTHRAPPLVVSPKAVSDSKNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDDEGRIIEFAEKPKGEQLKAMQVDTTILGLDDQRAKEMPYIASMGIYVVSKNVMLDLLRDKFPGANDFGSEVIPGATSMGLRVQAYLYDGYWEDIGTIEAFYNANLGITKKPVPDFSFYDRSSPIYTQPRYLPPSKMLDADVTDSVIGEGCVIKNCKIHHSVVGLRSCISEGAVIEDTLLMGADYYETDADRRFLAAKGSVPIGIGKSSHIKRAIIDKNARIGDNVKIINSDNVQEAARETDGYFIKSGIVTVIKDALIPSGTVI

SEQ ID NO: 222 - protein, 452 aa, Zea mays
  DOMAIN (1)...(452): CA1
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFHFVEDWVRIGSPAKNKVKKEHASVPFDDQCSILEKEAVNVSLQNLKSYPFVKEGLAGGTLKLVGAHYDFVKGQFVTWEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSLQDGAPDTFHFVEDWVKIGFIAKMKVKKEHASVPFDDQCSILEKEAVNVSLENLKTYPFVKEGLANGTLKLIGAHYDFVSGEFLTWKK

SEQ ID NO: 223 - protein, 653 aa, Zea mays
  DOMAIN (1)...(653): Carbonic anhydrase
MYTLPVRATTSSIVPACHPRAVLLLRLRPPGSGSSGTPRLRRPATVVGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFTFVEDWVRIGSPAKNKVKKEHASVPFDDQCSILEKEAVNVSLQNLKSYPFVKEGLAGGTLKLVGAHYSFVKGQFVTWEPPQDAIERLTSGFQQFKVNVYDKKPELFGPLKSGQAPKYMVFACSDSRVCPSVTLGLQPAKAFTVRNIAAMVPGYDKTKYTGIGSAIEYAVCALKVEVLVVIGHSCCGGIRALLSLKDGAPDNFHFVEDWVRIGSPAKNKVKKEHASVPFDDQCSILEKEAVNVSLQNLKSYPLVKEGLAGGTSSGWPHYDFVKGQFVTWEPPQDAIERLTSGFQQFKVNVYDKKPELFGPLKSGQAPKYMVFACSDSRVSPSVTLGLQPGEAFTVRNIAAMVPGYDKTKYTGIGSAIEYAVCALKVEVLVVIGHSCCGGIRALLSLQDGAPDTFHFVEDWVKIAFIAKMKVKKEHASVPFDDQWSILEKEAVNVSLENLKTYPFVKEGLANGTLKLIGAHYDFVSGEFLTWKK

SEQ ID NO: 224 - protein, 251 aa, Brachypodium distachyon
  DOMAIN (1)...(251): Carbonic anhydrase
MSGCLCLPCCYKKSPPGNGESPAAIDSSSSSLLQKPTYPPPPPPPSSSKMDAAVERLKTGFEKFKTEVYDKKPDVFEPLKAGQAPKYMVFACADSRVCPSVTLGLEPGEAFTVRNIANMVPSYCKNKYAGVGSAIEYAVCALKVEVIVVIGHSRCGGIKALLSLKDGADDSFHFVEDWVRIGFPAKKKVQTECASMPFDDQCAVLEKEAVNVSLENLKTYPFVKEGVANGTLKLVGGHYDFVSGKFDTWEL

SEQ ID NO: 225 - protein, 204 aa, Saccharum hybrid cultivar R570
  DOMAIN (1)...(204): Carbonic anhydrase
MADAVQRLKSGFNKFKTEVYDKKPELFEPLKAGQSPKYMVFACADSRVCPSVTLGLQPGEAFTVRNIAAMVPAYDKTKYTGIGSAIEYAVCALKVEVLVVIGHSCCGGIRALLSLQDGAPDNFHFVEDWVRIGFPAKVKVKKEHASVPFDDQCSILEKEAVNVSLENLKTYPFVKEGLANGTLRLVGGHYNFVSGEFHTWEIKS

SEQ ID NO: 226 - protein, 202 aa, Saccharum hybrid cultivar R570
  DOMAIN (1)...(202): Carbonic anhydrase
MADAVERLKTGFEQFKADVYDKKPELFEPLKAHQSPKYMVFACSDSRVCPSVTLGLHPGEAFSVRNIASMVPPYDKTKYAGVGSAIEYAVCALKVEVIVVIGHSRCGGIKALLSLEDGAPDKFHFVEEWVRIGAPAKTKVKADHASVPFEDQCSILEKEAVNVSLENLKTYPFVKEGLEKGTLKLVGGHYDFVNGKFETWDP

SEQ ID NO: 227 - protein, 257 aa, Brachypodium distachyon
  DOMAIN (1)...(257): Carbonic anhydrase
MSTAAANWCYATVAPRAKSVVVASLGTPAPSSSGSFRPRLIRNAPVQAAPVAPALMDAAVERLKTGFEKFKTEVYDKKPDVFEPLKAGQAPKYMVFACADSRVCPSVTLGLEPGEAFTVRNIANMVPSYCKNKYAGVGSAIEYAVCALKVEVIVVIGHSRCGGIKALLSLKDGADDSFHFVEDWVRIGFPAKKKVQTECASMPFDDQCAVLEKEAVNVSLENLKTYPFVKEGVANGTLKLVGGHYDFVSGKFDTWEL

SEQ ID NO: 228 - protein, 202 aa, Aegilops tauschii
  DOMAIN (1)...(202): Carbonic anhydrase
MDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 229 - protein, 202 aa, Oryza sativa
  DOMAIN (1)...(202): Carbonic anhydrase
MDAAVDRLKDGFAKFKTEFYDKKPELFEPLKAGQAPKYMVFSCADSRVCPSVTMGLEPGEAFTVRNIANMVPAYCKIKHAGVGSAIEYAVCALKVELIVVIGHSRCGGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 230 - protein, 259 aa, Secale cereale x Triticum turgidum subsp. durum
  DOMAIN (1)...(256): Carbonic anhydrase
MSTAAANWCYATVVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 231 - protein, 324 aa, Hordeum vulgare
  DOMAIN (1)...(324): Carbonic anhydrase
MSLQIGRTERARSPVFVFAHKRQLLHGRCSTIDNANCSTCSMKINSTCTLTALPIAALPGPRTTSHYSTAAANWCYATVAPRARSSTIAASLGTPAPSSSASFRPKLIRTTPVQAAPVAPALMDAAVERLKTGFEKFKTEVYDKKPDFFEPLKAGQAPKYMVFACADSRVCPSVTLGLEPGEAFTIRNIANMVPAYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVTNGTLKLVGGHYDFVSGKFETWEQ

SEQ ID NO: 232 - protein, 258 aa, Triticum aestivum
  DOMAIN (1)...(258): Carbonic anhydrase
MSTAAANWCYATVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSGIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 233 - protein, 249 aa, Cenchrus americanus
  DOMAIN (1)...(249): Carbonic anhydrase
MSTFAVRARGSSSIVASLGTPKQQPSSARPRLIRNAPVFAAATTTVVGMDHIQRLQSGFDKFKTEVYDKKPELFEPLKDGQAPRYMVFACSDSRCCPSVTLGLQPGEAFTVRNIAAMVPPYDKTKYTGIGSAIEYAVCALKVEVLTVIGHSRCGGIKALLSMKDGAPDNFHFVEDWVRIGFQAKKKVLTNHGSVPFDDQCTLLEKEAVNVSPLNLLTYPWVKEGVAAGTLKLVGGHYDFVNGVFSVWEK

SEQ ID NO: 234 - protein, 219 aa, Saccharum hybrid cultivar R570
  DOMAIN (1)...(219): Carbonic anhydrase
MDAVERLKVGFQKFKTEVYDKKPELFEPLKGRPGPPRYYMVFACADSRVCPSVTLGLQPGEAFTVRNIAAMVPPYDKVRTKYTGIGSAIEYAVCALKVQVLVVIGHSCCGGIRALLSLQDGAPDNFHFVEDWVKIGFPAKMKVKKEHASVPFDDQCYILEKEAVNVSLENLKTYPFVKEGLAKGTLKLVGGHYDFVRGGVPHMESLELSHLVGPTPTSS

SEQ ID NO: 235 - protein, 240 aa, Urochloa panicoides
  DOMAIN (1)...(240): Carbonic anhydrase
MSALAIRSAPSSIIASVRTPAHRRPGLVRNAAATTAELTMDPVERLQSGFKQFKSEVYDKKPELFEPLKEGQAPTYMVFACSDSRCCPSVTLGLKPGEAFTVRNIAAMVPPYDKNRYTGIGSAIEYAVCALKVKVLTVIGHSRCGGIKALLSMQDGAADNFHFVEDWVRIGFLAKKKVLTDHPMAPFDDQCSILEKEAVNVSLYNLLTYPWVKEGVSNGSLKLVGGHYDFVKGAFVTWEK

SEQ ID NO: 236 - protein, 272 aa, Oryza sativa
  DOMAIN (1)...(272): Carbonic anhydrase
MSTAAAAAAAQSWCFATVTPRSRATVVASLASPSPSSSSSSSNSSNLPAPFRPRLIRNTPVFAAPVAPAAMDAAVDRLKDGFAKFKTEFYDKKPELFEPLKAGQAPKYMVFSCADSRVCPSVTMGLEPGEAFTVRNIANMVPAYCKIKHAGVGSAIEYAVCALKVELIVVIGHSRCGGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 237 - protein, 202 aa, Aegilops tauschii
  DOMAIN (1)...(202): Carbonic anhydrase
MDPAVERLKTGFEKFKTEVYDQKPDLFEPLKAHQSPKYMVFACADSRVCPSVTLGLEPGEAFTVRNIAAMVPCYCKNKHTGVGSAIEYAVCALKVEFIVVIGHSRCGGIKALLNLKDGADDTFHFVEDWVRIGYPARKKVKDECSEMPFEEQCGVLEKEAVNVSLQNLSTYPFVKEAVANGTLKLVGGHYDFVSGKFDTWAL

SEQ ID NO: 238 - protein, 266 aa, Elaeis guineensis
  DOMAIN (1)...(266): Carbonic anhydrase
MSTAAAQGWCLTSLARANSPRPTTLRPTAVSSLTPSSSSPSPSTPRLIRNSPVFAAPSTIATAVEMEPVERIKTGFELFKKEFYDKKPDLFGPLAEGQSPKFMVFACADSRVCPSVVLNFQPGEAFTIRNIANMVPPYDQTKYAGVGSAIEYAVIHLKVENIVVIGHSRCGGIKGLMSLKDDGTTSTDFIEAWVKIGLPARDKVKAQHAGLPFEDQCTLCEKEAVNVSLQNLLTYPFVKEGLAKKTLKLIGGHYDFVKGSFETWEP

SEQ ID NO: 239 - protein, 250 aa, Triticum aestivum
  DOMAIN (1)...(250): Carbonic anhydrase
MGACCCCFPSKPPRENPMHPTAEPLIQRKPNHTPPYHQRPPVITHAHKGMNAVVRLKTGFERFRTNVYNKNPKLFESLRKDQSPKYMVFACADSRVSPTITLGLNPGEAFTVRNIAGMVPAYQKTRHCSVGSAIEFALVVLKVECIVVIGHSRCGGIRELLSLNDEGPNAYHFIEDWVKIGMEAKKKVQRENRLLPFDDQCTVLEKEAVNISLRNLKSYPFVKDRLNKGTLNLIGARYDFVRGSFETWNA

SEQ ID NO: 240 - protein, 266 aa, Phoenix dactylifera
  DOMAIN (1)...(266): Carbonic anhydrase
MSTAAAQGWCLTSLARANSRRPTTVRPAAVSGLTPSSPSPSPSTPRLIRNSPVFAAPSTIATAVEMEPVERMKTGFEQFKKEVYDKKPDLFGQLAEGQSPKFMVFACADSRVCPSVVLNFQPGEAFTIRNIANMVPPYDQTKYAGVGSAIEYAVIHLKVENIVVIGHSRCGGIKGLMSVKDDGTTSTAFIEDWVKICLPAREKVKAQHAGLPFEDQCTQCEKEAVNVSLQNLLTYPFVKEGLEKKTLKLIGGHYDFVKGSFETWEA

SEQ ID NO: 241 - protein, 250 aa, Hordeum vulgare
  DOMAIN (1)...(250): Carbonic anhydrase
MGGCCCCFPSKPPRENPMHPAAESPIQRKPNHTLPCHQPPPVITHTQKGMNAVVRLKTGFERFRTNVYMKNPKLFESLKKDQSPKYMVFACADSRVSPTITLGLNPGEAFTVRNIAGMVPAYRKTRDCSIGSAIEFAVVVLKVECIVVIGHSRCGGIRELLSLKNEGPNAYHFIEDWVKIGMEAKKKVQREYRLLPFDDQCTVLEKEAVNVSLRNLKSYPFVKDRLNKGALNLIGARYDFVCGSFETWNA

SEQ ID NO: 242 - protein, 208 aa, Phoenix dactylifera
  DOMAIN (1)...(208): Carbonic anhydrase
MHCPVKEMEPVERMMSGFEQFKKEVFDKKPDFFGQLAEGQSPKFMVFACADSRVCPSVVLNFQPGEAFTVRNIASMVPPYDPTKYAGVGAAIEYAVLHLKVDSIVVIGHSRCGGIKGLMSIKDDGTTSTDFIESWVKIGLVAREKVKAQHAALPFQDQCTQCEKEAVNVSLQNLLTYPFVKEGLEKKTLRLFGGHYDFVKGSFETWEP

SEQ ID NO: 243 - protein, 261 aa, Musa acuminata
  DOMAIN (1)...(261): Carbonic anhydrase
MSTTAAVHCVATLVRANKPTTAIHKKPTSSSSSTPSPSFPRLIRNSPIFAAPTTVAPAVEMEPLERVQSGFVQFKKEVYEKKSDLFAELKEGQSPKFMVFACADSRVCPSVVLNFQPGEAFTIRNIANMVPPYDQVKYAGVGAAIEYAVLHLKVQNIMVIGHSRCGGIKGLMSIKDDGTTSTDFIEDWVKICLPARDKVKAEHAALSFEEQCTKCEKEAVNVSLQNLKTYPFVKEAVEKKSLKLIGAHYNFVNGNFETWED

SEQ ID NO: 244 - protein, 253 aa, Brachypodium distachyon
  DOMAIN (1)...(253): Carbonic anhydrase
MGGCCCCCFPASAKPRRENPMHPATESLIQRNPDHTVPHHHPPQEVKNTGKGTKAAVRLKTGFERFKTTIYDKNLKLFEPLKTSQTPKYMVFACSDSRVCPTLTLGLQPGEAFTVRNIAGMVPAYQEKRHCSIGSAIEFAVVVLKVECIVVMGHSRCAGIKELLSLKADRPHAYHFIEDWVKVGMNAKRKVLRENRLLPFDDQCTVLEKEAVNESLANLKSYPFVKDRLRKGTLSLLGARYDFVNVSLETWNP

SEQ ID NO: 245 - protein, 246 aa, Aegilops tauschii
  DOMAIN (1)...(246): Carbonic anhydrase
MGGCCCCFPSKPPRENPMHPIAEPLIKRKPNHTPPYHQRPPVTTHAHKGMNAVVRLKTGFERFRTNVNNKNPKLFESLRKDQSPKYMVFACADSRVSPTITLGLNPGEAFTVRNIAGMVPAYQKTRHCSVGSAIEFAVVVLKVASSFCRCGGIRELLSLKDEGPNAYHFIEDWVKIGMEAKKKVQRENRLLPFDDQCTVLEKEAVNISLRNLKSYPFVKDRLNKGTLNLIGARYDFVHGSFETWNA

SEQ ID NO: 246 - protein, 257 aa, Amborella trichopoda
  DOMAIN (1)...(257): Carbonic anhydrase
MGKDSYEEVIAGLQKLLSESASLKPEAVQKIEQITSELKGAVAEAVSPTVEKIKTGFETFKKNIYEKKPEVFGELAEGQSPKFMVFACSDSRVCPSHILGFQPGEAFMVRNIANMVPPYDQVKYAGMGAAIEYAVLHLKVENIIVVGHSRCGGIKGLMSLNDDGSTTTDFIEDWVKICLPAKNKVRSQYGSLPAAEQCSKCEVEAVNVSLGNLITYPFVREGVANGTLALYGGYYNFVDGSFQTWGVNYGFTPINKI

SEQ ID NO: 247 - protein, 181 aa, Triticum urartu
  DOMAIN (1)...(181): Carbonic anhydrase
MDPAVERLKTGFEKFKTEVYDQKPDLFEPLKAHQSPKYMVFACADSRVCPSVTLGLEPGEAFTVRNIAAMVPCYCKNKHTGVGSAIEYAVCALQAARLVSISHFVEDWVRIGFPARKKVKDECSEMSPEEQCGVLEKEAVNVSLQNLSTYPFVKEAVANGTLKLVGGHYDFVSGKFDTWAL

SEQ ID NO: 248 - protein, 257 aa, Tarenaya hassleriana
  DOMAIN (1)...(257): Carbonic anhydrase
MATDSYEDAIAGLEELLSKKSDLGNVAAAKIKQLTAELKEVGSSRSDAVERIKSGFILFKTQKYEKNPDLFGQLAKGQSPKFMVFACSDSRVCPSHVLNFQPGEAFVVRNIANMVPPYDKKRHSGVGAAIEYAVLHLKVENIVVIGHSCCGGIKGLMSIEDDAAPTKSDFIENWVKICAPAKNKIKQELTEMSFDEQCTNCEKEAVNVSLGNLLSYPFVREGVVKNTLSIRGAHYDFVNGTFELWELDFKTTPAFAF

SEQ ID NO: 249 - protein, 255 aa, Solanum lycopersicum
  DOMAIN (1)...(255): Carbonic anhydrase
MANKSYEEAIVSLQNLISEKGELGPFVAERIDEMTAELQTSSKPFDPVHRIKCGFNYFKTEIYDKNPELFDKLKKGQEPKFFVFACSDSRVSPSHILNFQPGEAFMVRNIANMVPPYDKLRYSGTGAAIEYAVLHLKVENILVIGHSSCGGIKALMSLPEDGSESTEFIENWVKIGLPAKAKVLAEHPNISFEEQCKYCEKEAVNVSLANLLTYPFVRDGLVNKTLSLKGGYYDFIKGEFKLWGLHFGLSHPCSI

SEQ ID NO: 250 - protein, 258 aa, Flaveria bidentis
  DOMAIN (1)...(258): Carbonic anhydrase
MGSKSYDEAIAALKKLLSEKKELAPMAAAKIDQITAQLQTLDSTKPGFDPVERIKTGFAKFKTEKYLKNPALYGELSKGQSPKFMAFACSDSRVCPSHVLDFQPGEAFVVRNVANIVPPFDKLKYAGVGSAVEYAVLHLKVEQIVVIGHSKCGGIKGLMTFPDEGPTSTDFIEDWVKVGLPAKSKVKAEHGSASIDDQCVSCEKEAVNVSLANLLTYPFVRNGLINKTLAIKGAHYDFVNGTFELWALEFSLSPTTSA

SEQ ID NO: 251 - protein, 327 aa, Flaveria cronquistii
  DOMAIN (1)...(327): Carbonic anhydrase
MSATAAAFAPSFTTSLRKPSSSSSTVSTCFARLSNSSQSSSSATPPPSLIRNQPVFAAPTPIITPTVRGDMGSESYDEAIAALKKLLSEKEDLAHVAAAKIDQITAQLQTPDAKPAFDAVERIKTGFSKFKTEKYLTNPALYDELSKGQSPKFMVFACSDSRVCPSHVLDFQPGEAFVVRNVANMVPPFDKLKYAGVGSAVEYAVLHLKVEQIVVIGHSKCGGIKGLMTFPDEGPTSTDFIEDWVKVGLPAKSKVKAEHGSASLDDQCVSCEKEAVNVSLANLLTYPFVRNGLVNKTLALKGAHYDFVNGTFELWGLDFSLSPPTSA

SEQ ID NO: 252 - protein, 332 aa, Flaveria anomala
  DOMAIN (1)...(332): Carbonic anhydrase
MYATAAALIAPSFTTSLRKPSSSSSSSTVSARFSTLSNNSQSSSSSSATPPPSLIRNQPVFAAPTPIITPTVRGDMGSESYDEAIAALKKLLSEKKELAPVAAAKIDEITAQLQTLDTKPAFDAVDRIKTGFAKFKTEKYLTNPALYDELSKGQSPKFMVFACSDSRVCPSHVLDFQPGEAFVVRNVANIVPPFDKLKYAGVGSAVEYAVLHLKVEQIVVIGHSKCGGIKGLMTFPDEGPTSTDFIEDWVRVGLPAKSKVKAEHASASIDDQCVSCEKEAVNVSLANLLTYPFVRNGLINKTLALKGAHYDFVNGAFELWGLDFNLSPPTFA

SEQ ID NO: 253 - protein, 331 aa, Flaveria linearis
  DOMAIN (1)...(331): Carbonic anhydrase
MYATAAALIAPSFTTSLRKPSSSSSTVSAPFARLITNNSLASSSLSATPPPSLIRNQPVFAAPTPIITPTVRGDMGSESYDEAIAALKKLLSEREDLAPVAAAKIDEITSQLQTLDTKPAFDAVERIKTGFAKFKTEKYLTNPALYDELSKGQSPKFMVFACSDSRVCPSHVLDFQPGEAFVVRNVANIVPPFDKLKYAGVGSAVEYAVLHLKVEQIVVIGHSKCGGIKGLMTFPDEGPTSTDFIEDWVRVGLPAKSKVKAEHGSASIDDQCVSCEKEAVNVSLANLLTYPFVRNGLINKTLALKGAHYDFVNGTFELWGLDFCLSPPTSA

SEQ ID NO: 254 - protein, 258 aa, Brassica napus
  DOMAIN (1)...(258): Carbonic anhydrase
MATESYEAAIKGLNDLLSKKTDLGNVAAEKIKVLTQELKELDSSNNDAVERIKSGFTHFKTEKYLKNDALFSDLAKGQSPKFLVFACSDSRVCPSHILNFQPGEAFVVRNIANMVPPFDQKRHSGVGAAVEYAVVHLKVENIVVIGHSCCGGIKGLMSIEDDAAPTQSDFIENWVKIGAPARNKIKEEHQDLSYDDQCNKCEKEAVNVSLGNLLSYPFVRAAVVKNTLAIRGAHYNFVKGTFDLWELDFKTTPAFAFS

SEQ ID NO: 255 - protein, 255 aa, Solanum tuberosum
  DOMAIN (1)...(255): Carbonic anhydrase
MTNKSYEEAIVSLQNLLSEKGELGPVVSKRIDEITAELQTSSKPFDPVHRIKCGFNYFKTEIYDKNPELFDKLKKGQEPKFLVFACSDSRVSPTNILNFQPGEAFMVRNIANMVPPYDKLRYSGTGAAIEYAVLDLQVENILVIGHSTCGGINALMSLPQDGSESTEFIENWVKIGLPAKAKVLTEHPNISFEEQCKYCEKEAVNVSLANLLTYPFVRDGLVNKKLALKGGYYDFIKGEFKLWGLHFGLSHPCSI

SEQ ID NO: 256 - protein, 256 aa, Populus trichocarpa
  DOMAIN (1)...(256): Carbonic anhydrase
MANESYEDAIAGLSKLLSEKADLGSVAAAKIKQITAELEAASSKGFDPVERIKTGFVQFRTEKYEKNPDLYGALAKGQSPKFMVFACSDSRVCPSHILNFQPGEAFMIRNIANMVPPYDKTKYSGVGAAIEYAVLHLKVENIVVIGHSCCGGIKGLMSIPDDGSTASDFIENWVKICSAAKSTVAKKAGSLTFEEQCHNCEKEAVNVSLGNLLTYPFVRDAVVNDAVSLKGAHYDFVKGTFELWDLDFTISPSISV

SEQ ID NO: 257 - protein, 258 aa, Orychophragmus violaceus
  DOMAIN (1)...(258): Carbonic anhydrase
MATESYEAAIKGLKDLLSKKADLGNVAAEKIKELTQELKELDSSNSDAVERIKSGFTHFKTEKYLKNDALFSALAKGQSPKFLVFACSDSRVCPSHILNFQPGEAFVVRNIANMVPPFDQKRHSGVGAAVEYAVVHLKVENILVIGHSCCGGIKGLMSIEDDAAPTQSDFIENWVKIGAPARNKIKEEHQDLSYDDQCNKCEKEAVNVSLGNLLSYPFVRAAVVKNTLAIRGAHYNFVKGTFDLWELDFKTTPAFAFS

SEQ ID NO: 258 - protein, 256 aa, Citrus clementina
  DOMAIN (1)...(256): Carbonic anhydrase
MANDAYEDAIAGLTKLLSEKSDLEGVAAAKIKQITADLEAAGSRDIDPVERMKTGFIQFKTEKYEKNPDLYGALAKGQSPKFLVFACSDSRVCPSHILNFQPGEAFMVRNIANMVPPYDQKKYSGAGAAIEYAVLHLKVENIVVIGHSCCGGIKGLMSIPDNGTTASDFIEEWVKICSSAKSKVKKECNDLSFEEQCKNCEKEAVNVSLGNLLTYPFVRESVVKNTLALKGAHYDFVNGKFELWDLDFNILPSVSV

SEQ ID NO: 259 - protein, 256 aa, Populus euphratica
  DOMAIN (1)...(256): Carbonic anhydrase
MANESYEDAIAGLSKLLSEKADLGSVAAAKIKQITAELEAVSSKGFDPVERIKTGFVHFRTEKYEKNPDLYGALAKGQSPKFMVFACSDSRVCPSHILNFQPGEAFMIRNIANMVPPYDKTKYSGVGAAIEYAVLHLKVESIVVIGHSCCGGIKGLMSIPDDGSTASDFIENWVKICSAAKSKVTEKSASLSFAEQCHNCEKEAVNVSLGNLLTYPFVRNAVVNDAVSLKGAHYDFVKGTFELWDLDFTISPSISV

SEQ ID NO: 260 - protein, 280 aa, Citrus sinensis
  DOMAIN (1)...(280): Carbonic anhydrase
MATKFSKCMMLCCVRKSPVAQREDMANDAYEDAIAGLTKLLSEKSDLEGVAAAKIKQITADLEAAGSRDIDPVERMKTGFIQFKTEKYEKNPDLYGALAKGQSPKFLVFACSDSRVCPSHILNFQPGEAFMVRNIANMVPPYDQKKYSGAGAAIEYAVLHLKVENIVVIGHSCCGGIKGLMSIPDNGTTASDFIEEWVKICSSAKSKVKKECNDLSFEEQCKNCEKEAVNVSLGNLLTYPFVRESVVKNTLALKGAHYDFVNGKFELWDLDFNILPSVSV

SEQ ID NO: 261 - protein, 258 aa, Brassica rapa
  DOMAIN (1)...(258): Carbonic anhydrase
MATESYEAAIKGLNDLLSKKTDLGNVAAEKIKVLTQELKELDSSNNDAVERIKSGFTHFKTEKYLKNDALFSDLAKGQSPKFLVFACSDSRVCPSHILNFQPGEAFVVRNIANMVPPFDQKRHSGVGAAVEYAVVHLKVENIVVIGHSCCGGIKGLMSIEDDAAPTQSDFIENWVKIGAPARNKIKEENQDLSYDDQCNKCEKEAVNVSLGNLLSYPFVRAAVVKNTLAIRGAHYNFVKGTFDLWELDFKTTPAYAFS

SEQ ID NO: 262 - protein, 328 aa, Petroselinum crispum
  DOMAIN (1)...(328): Carbonic anhydrase
MSSITINNWCFTPVSPAQSSSSVATKLHLRPSVSARLSSSSSSSSNSLPSLIRNEPVFAAPAPLITPILGEDMGTEYEEAIAGLKKLISEKGELGPVAAAKVDQITAELKTPDGGKAFDPVERLKTGFIKFKKEKYETNPALYEELSKGQSPKFMVFACSDSRVCPSHVLDFQPGEAFVVRNVANMVPPFDKVKHTGVGSAVEYAVLHLKVSNIVVIGHSACGGIKGLMSFTFEGPNSTDFIEDWVKIGLPAKSKVLAEHGSKPFGDQCTCCEKEAVNVSLSNLLTYPFVRDGLVNKTLALKGGYYDFVNGSFELWGLDFSLSPPTSV

SEQ ID NO: 263 - protein, 256 aa, Coffea canephora
  DOMAIN (1)...(256): Carbonic anhydrase
MGKDKYEEAIAGLQKLLSEKDQLEDVAAAKIRQLTADLEATAKKPFDPVERIKAGFGHFKKEIYEKNPGLFGELAKGQSPKFMVFACADSRVCPSVILNFQPGEAFVVRNIANMVPPYDKTKYSGAGAAVEYAVLHLKVENILVIGHSCCGGIKGLMSIPDDGTTSSDFIEDWVKICLPAKAKIKSTCSGLDFAEQCTNLEKEAVNISLGNLLTYPFVREAVAKKTLALRGGHYDFVKGSFELWDLDFNLLPALTI

SEQ ID NO: 264 - protein, 269 aa, Nelumbo nucifera
  DOMAIN (1)...(269): Carbonic anhydrase
MGKDSYEEAIAGLQQLLREKGDLEAVAAAKIEQITAELQGAVVDGKVFDPVERMKHGFVHFKTEKFQKSPALFGELAKGQSPKFMVFACSDSRVCPSHILNLQPGEAFMVRNIANMVPAYDQTRYSGVGAAIEYAVLHLKVQNIVVVGHSCCGGIKGLMSIPDDGSTSTDFIEDWVKICLPAKHKVNAEYSSLPFPDQCSQCEKEAVNVSLGNLLTYPFVREGLVKKTLALKGGYYDFVNGTFELWGLDFGLTPSLSVREVASILHWKL

SEQ ID NO: 265 - protein, 253 aa, Leucaena leucocephala
  DOMAIN (1)...(253): Carbonic anhydrase
MAGQSYEEAIAELKKLISEKADLGGVAAAKIKQLTAELSAADSKPIKPDERIRTGFTHFKKEKFEKNPDLFGKLATGQSPKFLVFACSDSRVCPSHVLDFQPGEAFVVRNIANMIPPYDQTKYSGTGAAIEYAVLHLKVENIVVIGHSCCGGIKGLMSIPDDGTTSSEFIENWVQICNPAKSKVKADTKSLSFSEQCTNCEKEAVNVSLANLLSYPFVRDGVVKKTLVLKGAHYDFVNGTFDLWDLDLKMSPL

SEQ ID NO: 266 - protein, 335 aa, Fragaria vesca
  DOMAIN (1)...(335): Carbonic anhydrase
MSATSIINSVRLTTSASSSSGLSPSSQPNSFNPRKPTLLRVASSRSPPNLIQNKPVFTVPSPVPAEDMGKNYEEAIAALQKLLSEKDDLKTVAASKVEQITAQLATADAGSNPFDPVERIKTGFIKFKKEKYDTNPALYGELAKGQAPKFMLFACSDSRVCPSHILDMQPGEAFVVRNVANMVPPYDKVKYAGTGSAIEYAVLHLKVSYIVVIGHSACGGIKGLLSFPDDGPTSTDFIEDWVKIGRAAKTKVKALHEGASFPELCTHCEKEAVNVSIGNLLSYPFVRDGLVNKTLGLKGGYYDFVKGNFELWDVDFGLSPDFSVKDVATVLHWKL

SEQ ID NO: 267 - protein, 326 aa, Ricinus communis
  DOMAIN (1)...(326): Carbonic anhydrase
MSTASINGWCLTSLSPSQSSLRRSTLRPSVFARLNSSPTSSSSTPTLIRNEPVFAAPAPIINPSLREEMGKEAYDEAIEALKKLLSEKGELKAEATAKVEQITAELQTASSDSKPFNPVERMKEGFIHFKKEKYDKNPGLYSELSKGQSPKFMVFACSDSRVCPSHILDFQPGEAFVVRNVANMVPPYDQTKYAGVGAAVEYAVLHLKVEYIVVIGHSCCGGIKGLMSFPYDGNKSTDFIEDWVAVGLPAKSKVIAERGSVPFPDQCTYCEKEAVNVSLANLLTYPFVRDALASKTLGLKGAYYDFVSGKFELWGLEYSFTPSLSV

SEQ ID NO: 268 - protein, 234 aa, Nicotiana tomentosiformis
  DOMAIN (1)...(234): Carbonic anhydrase
MAEEISYENATNGEVKKLVSGGGKEFDPDERIRSGFAYFKTEKYDKDPELYEELAKDQSPKFLVFSCSDSRVCPSHILNFQPGEAFMVRNIANMVPPYDQIKYSGAGASIEYAIVHLKVENILVMGHSCCGGIKGLMSIPDDGSIDSHFIEEWVKICLISKAKVKREHGDKDFTEQCTILEKEAVNESLANLLTYPFVREAVVNKSLALKGGHYDFVNGSFELWDLEFNQLLQN

We claim:

1. A method of expressing a gene of interest in a plant comprising transforming a plant cell with a DNA construct comprising a promoter sequence, wherein said promoter sequence comprises the nucleic acid sequence set forth in SEQ ID NO: 3, and wherein said promoter sequence is operably linked to a second nucleic acid sequence encoding a functional protein, and regenerating a transformed plant.

2. The method of claim 1, wherein said second nucleic acid sequence encodes a protein involved in photosynthesis.

3. The method of claim 1, wherein said second nucleic acid encodes an enzyme with sedoheptulose-1,7-bisphosphatase activity.

4. The method of claim 3, wherein said second nucleic acid comprises the sequence of SEQ ID NO: 1 or a sequence having at least 90% sequence identity to the sequence of SEQ ID NO: 1.

5. The method of claim 3, wherein said nucleic acid sequence encodes the amino acid sequence of SEQ ID NO: 2 or an amino acid sequence having at least 90% sequence identity to the sequence of SEQ ID NO: 2.

6. The method of claim 1 where the transformed plant is a monocotyledonous plant.

7. The method of claim 1 where the transformed plant is a dicotyledonous plant.

8. A DNA construct comprising, in operable linkage,
   a. a promoter that functions in the plant cell,
   b. a nucleic acid sequence encoding a protein involved in photosynthesis,
wherein said promoter comprises the nucleotide sequence set forth in SEQ ID NO: 3, and wherein said promoter is heterologous to said nucleic acid sequence encoding a protein involved in photosynthesis.

9. The DNA construct of claim 8, wherein the nucleic acid sequence encoding a protein involved in photosynthesis comprises the nucleic acid sequence of SEQ ID NO: 1.

10. The DNA construct of claim 8, wherein the nucleic acid sequence encoding a protein involved in photosynthesis encodes the amino acid sequence of SEQ ID NO: 2.

11. A transformed plant comprising a DNA construct comprising a promoter that functions in a plant cell, wherein said promoter comprises the sequence set forth in SEQ ID NO: 3, and wherein said promoter is operably linked to a nucleic acid sequence encoding a protein involved in photosynthesis, and wherein said promoter is heterologous to said nucleic acid sequence encoding a protein involved in photosynthesis.

12. The transformed plant of claim 11 wherein said protein involved in photosynthesis is encoded by the sequence of SEQ ID NO: 1.

13. The transformed plant of claim 11 wherein said protein involved in photosynthesis comprises the sequence of SEQ ID NO: 2.

14. A method of modulating the growth of a plant comprising inserting into the nuclear genome of a plant cell a promoter sequence upstream of a photosynthetic gene of interest to alter the expression of a said photosynthetic gene, wherein said promoter sequence comprises the sequence set forth in SEQ ID NO: 3.

15. The method of claim 14 in which the photosynthetic gene encodes a protein with sedoheptulose-1,7-bisphosphatase activity.

16. A DNA construct comprising a promoter sequence, said promoter sequence comprising the nucleic acid sequence set forth in SEQ ID NO: 3, wherein said promoter sequence is operably linked to a nucleotide of interest encoding a protein involved in photosynthesis and wherein said promoter sequence and said nucleotide of interest are heterologous to each other.

17. The DNA construct of claim 16, wherein said nucleotide of interest encodes an enzyme having sedoheptulose-1,7-bisphosphatase activity.

18. The DNA construct of claim 17, wherein said enzyme having sedoheptulose-1,7-bisphosphatase activity shares at least 95% identity with the amino acid sequence set forth in SEQ ID NO:2.

19. Transformed seed of the plant of claim 11.

\* \* \* \* \*